United States Patent 9,932,598 (METABOLIC ENGINEERING OF MICROBIAL ORGANISMS) - sequence listing, part 3

SEQ ID NO: 1 - DNA, 4639675 bp, E. coli (residues 3,093,119-4,639,675 of 4,639,675)
aatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgggcgtaacaggattagaatggcattttattggcccgttgcagtctaataaaagccgcctggtggcagagcatttcgactggtgtcataccatcgaccgtttgcgcatcgctacccgtctcaacgaccagcgcccggcagaacttccccctcttaacgttctgattcaaattaacattagtgatgaaaacagtaagtccgggattcaactggctgaactggacgagctggcagctgcggtcgctgaactaccgcgtttacgtctgcgcgggttgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccaattatcgggccactgcgccgcgttattccggcaatggggccaattgacagcgcctcgctgctggttgcctatattctcagttttatcaaagccatcgtgctgtttaaagtggtgaccttcctgccaatcatctggattgccggtttactgattctgctgaaaaccatcggcctgctgattttctgggtcctgctggtgatggcgattatgagctgggtaagccaggggcgtagcccgattgaatacgtgctgattcagctggccgatccgctgctgcgcccgattcgccgcctgctaccggcaatgggtgggattgatttctcgccgatgatcctcgttctgctgctgtatgtcatcaatatgggtgtcgcagaagtattacaggcaaccggaaatatgctgctgccagggctgtggatggcgttatgaatgccgtaacagttaatgatgacggtctggttttacggctctatattcagccgaaagccagccgtgattctattgtcggtttacatggcgacgaagttaaagtcgccattaccgcgccgccggttgacggccaggccaacagtcatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgtcggtaaagtgcgtgagctggcgtcgctgcttagcgacttcggtcttgatatcgtggcccaaacagacctcggcgttgattccgctgaagaaaccggcctgacctttatcgaaaacgcgattctgaaagcgcgccatgcggcaaaagtgaccgctttaccggcaattgccgacgactctggtctggcggtagatgtgcttggcggcgcgccgggcatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccgggcgtgattactcgtgaaccagcgggcactggtggctttggttatgatccaatcttcttcgtaccttccgaagggaaaaccgccgccgaactgacccgcgaagaaaagagcgccatttcccaccgtggtcaggcgttgaaactgctgctggacgctttacgtaatggttaaattacctccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtaaagacaatctttattggcggtggtacgccgagcctgctttccggcccggcgatgcaaacgctgctggacggcgtgcgtgcgcgtttgccgctggcagcggatgcagaaattactatggaagcgaaccctggcacggtagaagccgatcgctttgtcgattatcagcgtgctggtgtgaaccgcatctctattggtgtgcagagttttagcgaagaaaagctgaaacgacttgggcgtattcatggcccgcaagaagcgaaacgcgcggcgaagctggcgagcggtttagggttacgtagctttaaccttgatttgatgcatgggctgccggatcaatcactggaagaggcgcttggcgatctacgccaggccattgaactgaatccgccgcatctttcctggtatcaactgaccatcgaacccaatacgctgtttggttcgcgaccaccggtgctgccggacgatgacgcgttgtgggatatattcgaacaggggcatcagttattaaccgcagcgggttatcagcaatatgaaacttccgcttacgccaaacccggttatcagtgccagcacaatctcaactactggcgctttggtgactacatcggtattggctgcggcgcacacggcaaagtgaccttcccggatgggcgcattctgcgtaccaccaaaacgcgtcatccgcgtggttttatgcaaggaaggtatctggaaagccagcgtgatgtcgaagccacagataagccgtttgagttctttatgaatcgcttccgtctgctggaggccgcgccgcgcgtggagtttattgcgtataccgggctttgcgaagatgtgattcgcccacagttagacgaggcgattgcccagggttatctcaccgaatgtgcggattactggcagataacggaacatgggaagctgtttttaaattcgctgctggagctttttctggctgagtaaacttgtattgccggatgcggcgtgaacgccttatccagccgacatgtggcagcggttgtaggtctgataagacgcgcaagcgtcgcatcagacgttgattgccggatgcggggtcaacgccgcatcctgctacaaatcgtgcactatatcaaacttacttaatcaccccattgcgccgcagttgttcggtatcttttttccagcgttcattagcttggttgatatcgtcaattttcatcaaaatcgcgacttttttactgtttatttctgaaactttcatcgttaacggatattgccctttttcgagcgttacccagtcatcctgcaatttacggctaagtttttgtgattgcagaaaagtctgtcgccgttgttcgttgatatcgaaatctcgtttctgctgaatcggcacttcataacactcttcactctgtttatgacatgccgcaatcgccggttgataaacctctttgtcatatttaaccgcgaacgcctcgctatcgttctgtttattaaactcatcacgctgttggtgaatttttttaaaggcgtcttcgcgggtcatttgcttaccgtttgcatcttttccccaatatgcatccgctgctttctgcgccgccaccatttgcttatcaagcgctttcacttccttttccagcgcaggaatcgagttcttctgggtattcaacgcagattcaagctgactaaagcgataattgaaatcttcgctattcacgatcagatatttattattcgttttgatatcgtcgaccacccgcccacgatcgctggctgccgcctgaaaagagtaaaagttcaccgaccagccagacgcgggcgttcctttactggttaacatcgccgagaattttaccggtttatctttcgtccaggtctgttcgagcagttcgtaatctgccaactgaccgacccaggtatagagatcgtcactggaagagacatcgccttccgctgaccaggtggcctgattacccttagcatcaagattttttaaggtgatagcatcaagcttgagaatgccgtgatactgctttttgaattgatcttttaagatattttcagttggcggttcgccatctgcccaggcattaccagtcatcaacataagcagtgccgtgccaacaatccattgctttttcacccgaaaaacctcacgcggaataatttattccggtgattatcattagggtaattaaaattggcaatggacgtgagtctgaagtgaaaaagccccggcacgataccggggcgaggcgattagtactgattgaagatctgctggatctgctgcggatctttggtttgcgtcagagccagttgcagcagaacgcgcgctttttgcgggttcagcgtgccagaggcgacgaagccgtatttcgcatcatccacttcggcatcctgagtggtagcgcccgtcggtacgcgggaagaacgcacgactgcagtaccggttttcgcggcggtcgccagcgtgtcgaacacagatttatacaggttgccgttacccacaccagcgctaacgatgccatcatagcccgcatctaccagtgctttagccggaagatcggatgcgttagcgtagttataaacaatgccgactttcggcagttcattcagcttagagacatcgaatggcgtgtcgctggtatgcttacgtgccggggtacgctggtagtcaatcttaccgttgtgaatgtaacccagaggaccgtagttaacagacttgaaggtcgctacgtcggtggtgttggttttggtgacgtcacggccatcaagcacggtgtcattcatcactaccagcacgccacggttggcggaggctttatcagctgcggtcactaccgcgttatacaggttgaatggaccgtctgcgctcatagacgtggacggacgcattgcgccgaccatcaccaccggtttgtcgcatttcaccgtcaggtcgaggaagtaagcagtttcttccatcgtgtcggtaccgtgggtaatgacgaagccgtcggtcttatcgcagtcggtgttaatttttttcgccagtgtcagccagacattatcgttcatgtcctgggagccgatattcactacctgctcgcctttaacgttcgcaatgtcttttagttgcggcaccgcattaaccagattttctacgccaactttacccactgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctctgtatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcagcccccccaggcttcccagcacattctgtaatgggttaccgccgcttttcagcaccgctttcgcgcccatttcattaatgctgtcctgtaaaattccacccattgcctgattcactaattgctggccttcggcgcgaacctgatcaatggctttatagtgaaacgtcaggccatcgctgcgcgtttcaataatgcggttcatctgctctttcagctgcgcatcaagtttggtcagacggctgcgcattttgctgctttcgcccatctcctgaacgataattttatccagagcaatacgggctttctcgacgcggcttttcgcgccttcatcaatccacggcagcgtgctgcgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaaaaaatcaggccagcatttgctggccccagattgataacaaagtacgcgttttccatgccggatgcggcgtaaacaccttatcccgcctactcgatcgtgcatctttccaggcctgataagcgtagcgcatcaggcagttttgcatttgtcatcgcccgtatgctttcttagtcccaccaaacgtcgaaaagttcgctggtgcgtacctcatccagtttgcgctcttccagccacttacgcacaatcgcctgatgttcttcggtgcatttgccgatttcctgcatgcagatcagaccttcccaggccagataaccgctgccgtcaaaggccagtttgttcggttcgataacctcgttaataaaatcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatacgccccccagctgcagtttgctttttaccagttcggcaaacggcacctgaacgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaaaccttcttcatgcgcagaagccaggcacgcaccaacgcccggtgaatgcacttcaatgccgaggaagtcctgctcagggcgatctttagccattgccaccagcgacgcccccatgccaaaaccaatctcaagcgtcaccggcgcttcacggccaaaaagcgcggggaaatccagcatatcttcgctgaactcaacgcccatcaccggccagtagttttccagcgcatgttcctggcctttggtcagtcgcccctggcggcgcacaaaactacggatacggcgcagtgggcggccgttttcatcaaattccggtgaaatgacgtcgtttttcataaaggtttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcgaaaaactctgccctggcaaattgacaagacgccctacaaagtatggctctcagaagtgatgttgcaacaaactcaggttgcgaccgttatcccctattttgaacgctttatggcgcgcttcccgacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaggaagttgcagcactgccgggcgtcgggcgttccaccgcaggcgcgattctctcgctttctctgggtaagcactttccgattctcgacggtaacgtcaaacgcgtgctggcgcgctgctatgctgtaagcggctggcctgggaaaaaagaggtcgagaataaattatggagtttgagcgagcaggtgacgcccgcggttggcgtggaacggtttaatcaggcgatgatggatttgggtgcgatgatttgtacgcgctcgaaaccgaaatgttcgctctgtccgctacaaaacggatgtattgccgccgccaacaatagctgggcgctttatccgggcaaaaaaccgaaacagacgctgccggagcgcaccggctactttttgctattacagcacgaagatgaagtattgctggcgcagcgtccgccgagcggattgtggggcggtttatactgtttcccgcagtttgccgacgaagaaagtttgcggcagtggctggcgcaacggcagattgctgccgataacctgacgcaactgaccgcgtttcggcataccttcagccatttccacttagatattgtgcctatgtggcttcccgtgtcgtcattcaccggctgcatggatgaaggcaatgcgctctggtataacttagcgcaaccgccgtcagttggcctagcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgagctgggaaaacgcatctataacgagatctccaaagaagcctgggcgcagtggcagcacaagcaaaccatgctgattaatgaaaagaaactcaacatgatgaatgccgagcaccgcaagctgcttgagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgctggtcctaaggactacgtgaaatacaccgatcaatatcagacccgcagccacatcaacttcgatgacggtacgattactatcgaaaccatcgccgggacagaacctgccgcgcatttgcgccgggcaattatcaaaacgttattgatgggtgacgatccgagttcggtcgatctctattccgacgttgatgatattacgatttcgaaagaacctttcctttacggtcaggtggtggacaacaccgggcagccgattcgctgggaaggtcgcgcaagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacggaaatatggcgttgatgagtcgctgattctggcaattatgcagaccgaatcttcctttaacccgtatgcggtcagccgttccgatgcgctgggattaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaatgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataattccattaaccgcccctgacgatgctcaggggcaaaaatgttatccacatcacaatttcgttttgcaaattgggaatgtttgcaattatttgccacaggtaacaaaaaaccagtccgcgaagttgatagaatcccatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctattggcgcagtttatagctcactgggtatcgcagcggtctttatgcctgcgctgctggggattgtggccgacaaatggttaagtgcgaaatgggtatatgccatttgccacaccattggcgctatcacgctgttcatggcggcacaggtcacgacaccggaagcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtctggcttcgaattaagccacatgcagctgtatattggcgcagcactttccgccattctggttctgtttaccctgactctgccgcatattccggttgctaaacagcaagcgaatcagagctggacaaccctgctgggcctcgatgcattcgcgctgtttaaaaacaagcgtatggcaatcttctttatcttctcaatgctgctgggcgcggaactgcagattaccaacatgttcggtaataccttcctgcacagcttcgacaaagatccgatgtttgccagcagctttattgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgcgctgtttgcttacggcgacccgactccgttcggtactgtactgctggtactgtcgatgatcgtttacggttgcgcattcgacttcttcaacatctctggttcggtgtttgtcgaaaaagaagttagcccggcaattcgcgccagtgcacaagggatgttcctgatgatgactaacggcttcggctgtatcctcggcggcatcgtgagcggtaaagttgttgagatgtacacccaaaacggcattaccgactggcagaccgtatggttgattttcgctggttactccgtggttctggccttcgcgttcatggcgatgttcaaatataaacacgttcgtgtcccgacaggcacacagacggttagccactaattacgcaaagaaaaacgggtcgccagaaggtgacccgttttttttattcttacttcaacacataaccgtacaaccgtttcacgccatccgcatcggtttcgctataaacaccttgcagctccggcgaaaatcccggcaacaaattcaccccttcttccagtgcaaggaaataacgttgaaccgccccaccccagacttccccgggtaccacgcaaagcacgccaggtggataaggcaacgccccttctgccgcaattcgcccttcggcatcacgaatccgcaccaactccacgtcaccgcgaatataagcgctatgcgcatcctgggggttcatcaccactgacgggaaactctgctggcggaacatcgctttttgtaggtctttgacgtcgaaactgacatacagatcgtgcatctcctgacacaactggcgcagggtgtagtcgcgatagcgcaccggatacttgttataaacgctcggcaacacctcaaccagcggcgagtcatcctcaatatgctgttcaaattgcgccagcatcgccaccagttgtgccagcttctcgtggctttccgccggagttaataaaaacagaatggagttgagatcgcacttctccggcacaatgccgttctcacgcagatagtgcgccagaatcgtcgccggaacgccaaagtcgctatattcgccggtttcggcatcgatacctggtgtagtgagtaacagcttgcacggatcaacaaaatactgatccgcggcatatccttcaaagccgtgccacttcgcccccggctcaaaactgaaaaaacggcggtcgctggctaacactgatgtcggataatcctgccacaatttgccatcaacaacgggcgggataaacgggcggaacagcttacagcgcgcaagaatagccttgcgcgcttcaatccctatctcaacacactcagcccacagccgacgcccactctccccttcatgaattttggcgttaacatccagtgcagcaaacagcggatagaaagggctggtagaagcatggagcataaaggcgttattcaaccgcttatgcgggcaaaaacgcgcctgtccgcggatatggttatcttttttatggatctgcgacgtctgtgagaatcccgcctgctgtttgtgcaccgactgagtcacaaagatccccggatcgttttcgttaagttctaacagcagcggcgagctatccgccatcatcgggataaattgttcataaccgacccacgcggaatcaaacagaatgtaatcacacagatgcccaacggtatcgatcacctgacgggcgttatagacagtgccgtcataggttcccagctgaataatcgccaggcgatacgggcgcggcaggtcggctttttctggcgcaacgtcgcgaatttgctggcgcagatactcttcattaaaacagtgcgcatcaataccgccaatgaaaccaaacgggttgcgtgaagcttccagatagaccggcgtcgcccccgcctgaatcagcgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcgaatttctgcgcatctttcgccgatccttcatgaataagcagatcgcccaattttacgtcagcgttacacatatcggcgcgaaagacgttctcaccaaagaaatcgtaaaaatggcgtccggcaggatgctttttaaaaaacgcaccatgttgatgtccagggcaagcaaaggtgctgttgcccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgccaccacgcgacgatgagaagaaagtcgggataccagttcactactggcggcaatattcattgatttcataagcgcaaacccgtttcggggaagtaagaataccggacaaggtggaaaaccctgccccatgagatatgggtcaaactggtcaccagctccgaccgccagacatcagtaaaagcagaaacgctctgattttactgttgtcctgcagtgagcgtgcgttaacttcaccgcatgagcagtaacatagaaagggaaacgtttcgcgcgaaacggcgataagcgagagaatgtaaggagatggcgtgcatcgggcaaactccgtacagagaggagaaaattcgcgcaatcatggcacctttcgctaaagcgtgcaagccaggactttgcgaacaaacaagccatcgacggcaccaaacggtcataataagaaaatcaaacaatacagctaacaggaactcttgtggtcatcggcccttttatcaacgctagtgcagtcttactgggtggcgttctcggcgcactgctcagccaacgcttaccggaacgtatccgcgtctccatgacatcaatttttggtctggcatcgctggggattggtattttactggtggtgaaatgtgccaaccttccagcgatggttttagctacgctacttggcgctctaattggcgaaatttgtttgctggagaaaggtgtcaatacagcagtcgccaaagcacaaaatctgtttcgtcactcacgtaagaagccagcgcatgaatcttttattcagaattatgtcgcgattattgtcctgttttgcgccagcggcaccgggatcttcggggcgatgaacgaagggatgaccggcgatccgagtattttaatcgccaagtcatttcttgatttctttacggcgatgatcttcgcctgctcgctgggtattgcggtatcggtgattagtatcccattactgatcatccagttaacgctggcgtgggctgccgcgctgattttaccgctgaccacaccgtcgatgatggcagacttcagcgccgtaggcggtttattgctgctggcaaccggattacgcatctgtggcattaaaatgttcccggtggtcaacatgcttccagcactccttctggcaatgccgctttccgccgcctggaccgcctggtttgcctgacaatgcgtgcaatatcggcaaagtgatgatagattgtgcagtctgcagtaaattgaagaaatttgattgacgagacgaggcgaatcaggtttaatgcgccccgttgcccggatagctcagtcggtagagcaggggattgaaaatccccgtgtccttggttcgattccgagtccgggcaccactaattcttaagaacccgcccacaaggcgggtttttgcttttggatctgacaataaccttcacgaaaaaaattagcttataaagtctgggggaattactctcgccacgttaacgagagtaattttattgatattaatctcctgatactttacccccgtccaaactccagccgctgcacattcaccatcccaggcttctcagcagcactgacatcaatttgtgtcacccgcagcgcatatttttcatccagtgcgtttaaccatttcagcaggtcattaaacaccacaggttctatccagacctgaatattctccccacgatcggctatccgcctgatgaccaccgagtgcgcggaagcactgtcactgatgacccgcgatacctgcgcaggcgttgttgtggcagattttcgcgctgcaataatatccggcgcggcgttcttcagtcgggtgttcatcgccaccagctgctgcaatattgtctcctgttgctcaatccgttcgctcaacggctgccagatgaggacgtaatatccgacgctaaacaggaacaccaccgctgccagtaacatgcccttttcacgcggagaacgccccgccaggtgttgtgccagccagtgttcgccacggcttaactggcgttcacgccattgctgaaaatagtgaataaatttatcgcgtaacatgttatttcctccgcaacgttacgccgccggaaaccgcatcaccctctttctgtaacgcgtcctgttgcacaacataatcggttgccagtacactacgcagtttgtcgaaactggcaaagttcgcggcccgtagctggaggtgaagtatctggcgtttttgatcaaaggtaaaaccacgcatttcgatgtcggaaagtgacgctgatttcagggtgctggctatcgctgacaactcggcgagcagccgggtatcgtcggcctgtgggcgatattttttcagcgccatcgtcacctgagagcgtaaattcacaatccgcttctgctccgggaacaacgttaagaactgttcctccgcctgggtgcggctttgcgccacctgttcgctgacgctccataacgtcacgccccgctccactgccagcgcaaccagaatcagcaatatcggcagaatcatcacccgccagcgcgcccactgttttcggtagctgacgcgaggctgccacggccctgtcagcaggttcccttccggttcgccataagtggtaatggcgggcagagctgtaacggtcaggcgttcagcgtctgcgccagcccatgctgatagcttttccggtgcaatgccgactacggttagcgaaagcggtaaatcctgctcattgagctgggcgcggaacatgaccggagccagcgccagcccggcgctccatccccggcattcatcgatgcggcagataacccgttgcgcatcgcaagccataaacccacaaggaatggacatccagtccggcgcgacggtagcgcgggtgatgccgttttcctgcaaccactgcgcaatgttgcgcatatgctgttggtgaatcactgctacggttgccagttgctggtcgatattcaacggggcgaaatgcagttcatcgatatcctggttcagctcttcttccagtaaggcgggcagaatagtcggtagcgcagcgcgatggaaatgtcgtggcgcgcacccttgcgtaaaaccgtaagttgaatggaatccattgaaggtaactgccgcatcagagcaatcattgctcgtggatcagtgaaatcctgctgatttagcgcaatggcgatatcgccttccttgaaaccgctggcatcgaacagagaacgatctgcccccggcttcgctgcataaccgacaatcccctccttacgcacaggcgtaagctggatatagttaaaaattttctgcggatctttcgccagtgcctgacgcacggcagccgggatctcaactggcacactgacagcaggctcagcaacagcttgctttgcttcgtcactgacggcttttttgttggtcacagcaacagtggaacgttcctcttctgccagactcagacgctctatttttccctgataacgcagcatcacatggtcgcggttgatttcctcaatcaccgcgttgtgagagccaagcgtttcaccctgcaaatagacctgctgtttaccgccttcttcaataaccgcgccgggtctggcaccaaaggcgatcccacgcagcaccacattaagacgcgtttctgccacaggcacaggttcgggttgttttacctgcgcggcgacaggctgatatttgccaaaccagttttgctggctgattaattgcacgtcatttttatcgaacgtttttgcatccacacggctcggtttattcaccggttgagaaaccgccgtatattccgcagaaaaggagatatagcgccagagtgaatgcgccatttttgcagaaataataagcagcatcagccagaacatcccgcgtgcaatttttcgcagatgctctttgtctgtattaagagattgtctctggttaagagtgtgacgaatttttgtcagccattgaatgagataaattcgtgcgtcacgaaaaacaacccgcgccaatttatatctacccgacgttatgctttgactattccacaggtggtacgatccagtttccgctgatactggttacctgtacgtgtatcattaatcgttatgctgtaattaattccctcagtgatcattaatttcaccgtcgggtcagcgcacatttgtcgttgatagctggttaaaaaggcgtcaggcgtctgcgtggtttgtgtacccgcttcgctgataatggtcatttttaccgttgtgccgctactttgcgccagcactaaggtatatcccgcagatttaatcggcaggttttggctgatattttgcgcctgttttttcgccagtaaactggcattttcattatggctggcacagccacttaataatcctgtaacgctcaacaatagcgatattaataccctccctggcatttgttttatcgacatggtaaataatctctaaggttattaataagagttaaaatgtcactttgataatgacgtggttatcattaaaacaatgcctgtagataaagtgttgctataccgcccagacttaaacacggtccaaaaggcagtgtggttgatcctctttttgtaataacggcatatatcaggccgcagcatgaggcgattaaagcaacattgggcagcgacaatgcccccacccagccacctaacgcggcgaaaagtaatacatcgcccatgcctaatgcttctttacgcagaactattccggctatccaacgcagagagtaaaaagtgataaatcccaccaggacgccggtgactgcatcttgtagcgtgagcggactctgctgcgcccatgccgcaatcagtcctgtccacaatacgccctgagtaaaaacatcgggcagccattggtgatcgaggtcgatgacactcgcggcaatcagccaggcggataatatcatcaccgccagcccccatccactttctggccagaccagactcgccagcaaaaaagcaagtgctgtcaataactccaccagcggataacgcttgctgattttcgcctgacagtcgcggcagcgccctttgagcatcagccaggagaacagcggaatattgtcacgtatccggatggtctgctgacaatgtgggcagtgcgaacgcggtagcgcaaggcttatttttgactgcgcactcgacatttcaccgtgaaactccgccatttgttggcgcagcatgattgggtaacgccaaatcaccacattcaaaaaactgccgatgatcaatcctccgacggttgccaggacgggcatcgccgtggggtattgctgaaaaacatcaaaaagcatggttaaaggttgtttgttgtaacttgctggatgcggcgtaaaacgccttatccgtcctacgggtgtctgccagcgcaaataatcgcggctttccccgtctgtaggcccgataagcaggcgcatcgggcaaatgtgttaacccggtgcgccttatttcatgccggatgcggcgcgagcgccttatccggcctacgggcttactcggcagacatcttatgctcggtaacctgattaatggtttccggtccctgttccggtttcggcagatcgagtgacgcgagcgtgttgtaagccgactggctcacaccgccctcgaagctcatctcgctcgcccccggcagctggtaagcattcgcgcccggattccatttcttaaagaactccgaaagatccgtctgggcgacccaggaggcacacagcatcagcgtgtccgctgcgttaccgttggattcagcacagtaattcttgccgccaaacttgtcattgctgacctcatcgccgcgtgctttacgatgcatcaactggaacaggttccagcctttcatcccttcacgctcgctgtaaaactctggcagaggagtgccatctggataccatttcttgatatcaaagtttttctctgcccattccttcagctgtgcgtacatcagcagacggtcacccgcaccgccgcgtgcccatgcctggttgttgctctcctccagatattccggtgcgacggtaatatcgtcagcgacacggttcatcttgccgagataacgatcctgcatgtacagcgccagcacgttgttagcgacttcagttgcacccggtacagtcaacggcgtttctgcggcgttatgaccgacttcatgccagatcagccagtcgttcagcggcgtcgtcggcagcgtggtgctgttcggcgagaagctgctgttcattaccggataacccgaatgcgcatcaccgatggagatctgcacatcgttggtgaaacgatgtttgtggcccggcaagtttttataggtaaacatccggtgcttaccgtcttcgctatcacggccgtagaagtcattcatcgagctggcaaaggtatccagatcgttagcgaattgctccagtccgccagtgtaattgctggcattcaggttcttcttcggtgtggtatagacgaaagcgtctgattccagctcacccagcggagccggtgagttcagatcgtttttccatgcgccgtctttatagaacggtgcttttaccacgccagtaaaggtgaagctggcagattcattggtagagctattgcccttgatataaatcaggccaccgtaaggcaccttgaacttcaccgtaccgctagcgtccagagagtacgttttagtcactcttggcggacggttcagcgcaacttcatgcttctcacgtccggtcaggtcgtcagccagcgccacggtgacggtcacaggaacgttcgcattggacttaatggtgacctctttctgagccggtgcccacaggccagttgactgcatgttacctgcaaaccatttggtcggattcgagtacaggctgatggtttcagtaacgttctgtccctcttccgatactgctcccggatacttctcgacatcaactttgatgttcagatcccaccaggaacggcccagcatcaggcgtgtcagcggtttttccatatagttgagcgggtagctcgggttcatcatgcccgctttgctgctaccgtcaccgtagatcatgttgttatcgaccagcgattttttcagatctgcagaacacttggtgccgcctgcataggcatcattggcgtagcagttcaggaactcggtgaacgttttaaagcccagctcgtcatttttgccttcttcataacgatagctcgtatcgttccacagccagaccgacatgttctggtacagacgttccagatcgacgctgctcagacgctcacctttgcgaccattggtccggaagtagagctcatgctgatacagacgctgaatgttggtgcctaaatccgcagcctgcaccatcgcttttgcagtgtcggcgttaaggcttagttgcgtatactgtggaacatacatgccaccagtaaccggaacccccgtgccaggacgatattccaggcagttgacctcatagtgatatgccggattagtacactctttcagccccgggaacgcggcgaaaattttctccttcgcagccttcagagaatcctctgttttatgatcggcctcatcaataaaggcataacgcgtttcctgtttgccatctacatcttccagccagctggcaacttccagcttcggtttgtcatcaggtttgttttctacctgatatttccacttaacttcccctgtcttactatcgatggtgtacggcagcgcaccatctacggcaggataacgttcatagacccaaatgcccgttgcgcgctgctgacgaacgcggttcggatacccttgcggatcgttatttactaccgacttgttcagtgccatcgacagacctgcggcatccaacagacgcacaaaaccagacgcgctctcttccttaagattgctcatcacgttttccatgatcagcaccgatccacctttgttcagataggcgatcagatcggtcacatcctgctgagtcagcttcggtttgctggtatctgcacgcagcgggattgcataaggatcgttacccacctgagtcacatattcaaagccgttaaggatcagcagcggcatttcctgcggatcgagatcgccatagctacttaaatgctcaacagagatgcccgcaaaatccggatggaagtcgaacgcagcgctgtttcctgtaacctgaccatgacgtttaaaatagacagtatccaggttggtgcctacggtcatgctggctttcgcgtccggcttccatttatcgtcggacagatagcgcagcacgttctccatgaagttcttcatgtcatccgggtcgctgttgagcgtacactgcccatctttattaacgcccccgttccagctgtaaccgttcgggcaacgcaaaatgctgttgtagtgtgggttaccgataaccatcagtttgccctcaccgacttgccccagcgaaataaacggcaggttaaaggtggcggtatcgcgcgtaacgttttccggctcaacaagagaaggcgcttccgtaatgtacgccagctcgtttttatcccaggcgcgtttttcgccgaaggccagccagtagtttttatcattacgcgccatcagaatcgggaaggccgcgttggagatattcaccaccgcctgaccgcgcgcattacccgtgctgccatagaagttggtggagtcatggaatacatggaacttgctgacagatttgtagttcgtatccacgccccacagcttgttgataacgccctgaatctggccgtcattaacattgcgcgtcgtcagcgagaaccagcgagcctcgttacaaccatcggttttcgcacaaatcgcggtatcgatctctttggcctgacccgtattaaactgctcaataaattcgttaggcagattaacgacttgctcaccttcccccagcgtcgcaccgttggataacgagagattgataatctcgttgatcacgttgggatattcggcaaagaccttgcgtacatcgtccggaacaacacgggtattattttgcccggtcgtcgaatagcgatgaataagctgatcaatattcgccccgcgaacttcatcacccagttcagtcagcgcaatggtcgacttattgccgcgcactgaacccagttcaaaggtatcgataccaaaggagatggtttcgccccagctaaaggaaaattcaccattttcccctgtcacgccacggcctgaattggtgtagtagttgacgccagcaacaccatatccctggctatcgaccagtcgaccttcagagagaatgatttcagtgggttgatactgataaaactgttccgcgttagccgacacgaaggaagcgttcagatccggttttgttcccggcgtggtgacgggcacgaccggtgaagtatgagtggatggcgctttatcggtcgcagcattgttttccacctcttcattgaccagctttttgaactcttccggtgccagatcgatttgcttatacagcgagtcgaagcgtttactctcgatcaccgaggagaacgtcagacaaacctgttctgtattcgccggacagctgttactggacgttaccagcgaaaccgcattgcttttcttgtcatcggagcccgccagttcttgcgcgtcctcaaggctaaacgacactttttcaaccgcacgcaagctacgcgcagcttctgactgagtgttgaaggtggcaattgtcgtgttacccgccacgcaagtaacgtcctcgccaggtttaaatgtaaagccatcgctggattcaccattacaggtagcaccagttacccgctggcttccgcccagggtcagataacccgttttcgtaggaacaggttctggctccggttctggtgttggttcaggatcaggtatcggttctggcgtaggctctgggtccggcgttggctcaggcgtcggctccgggtttggtgttggatcaggtttcacttccggcaaagaccctgttccagaatctacaggcggcgtatcggaggaagatccggaaccaccgccatcacaaccggctaacagggttgcgctcaaaatagccgctaaaagcgatttcttatatttaaatttcttattcattaataacgcaagtgacaaaacaatgttaaaaaattcgtaactgggagaaatagttttatgctttatcttctctaataacttcctccattcttaagaaaacgacatcattgatagaaaacaggtgaaatttataagaataacccctatacgatgtctatctggctatttttacgaaatttcaacaaacaaaaaattaacaacatttcacaacgtaactatataaatttgttggtagttttaacgattaagattgcaaaagcaacagatagaacggtgtttgctcatcaagcgaacataattaatacagacttgttttgcgtgataaaaaaatagatgttctcacgctcttaattatttagcaggttatctgaacgcaaaacattattgctgcatggataataaagcgagaaatgattttcaattaataagacagaataatgtaaatgaagccggatgatattaacgatcatccggctttattgatttacgagactaacatcccggtaaacacatacgcctgcagcagggtgataatgccgataacgctggcaaaaatcagactgtgcttcacggtgtagcggaacagttcagattctcggcccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgttagaggaggtgtccgagccggtaaggaatacgcccagccagccgagaaacggtgagaagaacgggaacatcacgcctgtacctgccagtaccagcgccagcgtggtggacatgccagaatagttggtgacgaaggcgaacgccagcaccatgccaatcgacagtatcggccacttcaagctaattagcgtttcggcaaagacgccaatacctttcttgatccccacaccgaggatgaagatagagataatcgccgcaataaaaatagcggtgccgccagccgagagggggtcgaatttaaacaccgcatccattggcgttggttgggcgacaatgggtgccgctttcaacacttgttgatgcaaatgagggatctggaaattaatcaccagtgaataaaacgcgccgcccggagcaaataacgctttaaacggcttcatggtccagatggtgaccagcaccgttaagattaaaaacggtgaccacgctcgaatgatttgccccagactatattctgaaggcacgggaccgccagaagatggcttatttaccaccatcgcacctgcggattgtcccatgctgattgccgtttcggtatttttcggccgccagactttaaggaataaagcgagtgagacgatactcaccagcgccgaagtaatatccggcagttccggaccaatatagttagaggtaaagaactgagtgacagcgaagcttcccccagcaaccagcgccgctggccacgtctctttcacccctttccagccgtccatcattgctaccagccagaacggcacaagaaccgacaggaacggtaactgacgtcccgccattgcgccaatgtggaacggatcgattcccgttacctgaccggcgaccagaatcggcacgcccaacgcaccaaacgccaccggcgcagtattggcaatcagacacagccccgccgcgtataacggtttgaagcccaggcccaccagcagcgcaccggtaatcgccaccggcgcaccaaagccagccgctccttccagcaacgcaccaaaggagaaaccaatcagtaacacctgcaaacgctgatcgtcggtgatggagataaccgagctgcggataatatcgaactgcccgctggcaacggttaatttatacaggaacaccgccgcgacaataatccacgctattggccataatccataaataaagccatagcccgcagcagcaaatgccatatcaatcggcattttaaaggcgaatattgcaatcaggatagataatataagggttattgctccagcgacatgtcctttcagacgtaataccgcgagtgcaacgaagaagaatattatcgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggcataacaagtatatcgggtaagggtttctgttccgcacacgcagacgcagagtatcgttaagatgtccatattgttgttttaggcccgctagtaatgcgctacgggtatttaatattgttaaaccctgataatcgctccggttatttccgggataaatgtactaccgcagttactatcatagccccgacaataaaacttgccggggcttttttgacgctattaatgactttctttttcgcgtaaacgccaggcgtgtaataacggttcggtatagccgtttggctgtttcacgccgaggaagattaaatcgctggcagctttaaaagcacacgagttagcgaaattccccgccatcggacgataagccggatcgccagcgttttgctgatcaaccactttcgccatattctccagcgacgcctgcacctgttctttggtcagaataccgtgacgtaaccagttggcgatatgctggctggagatacgcagcgttgcgcggtcttccatcaacgccacattgtgaatatccggcacttttgaacaaccaatcccctgctccacccagcgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgtacgctctgtacgttggtttggtggtagtgcagcgcatggagcgtagcagcggttggtgacggaacccaggctgtgtttgccccggcacgcagttggtcgcccttctggctgtacatgtctgccatcaggtccggcattgcccacatgcctttaccaatttgcgctttaccgcgcagcccacagaacagaccggaaagcacgttattacgctcgtaggctttgatccaaggcgtcgatttcatctgatttttacgcagcatcgggccagcttccatcaccgaatgcatttcatcgccggtacggtcgaggaaaccggtattgatgaacgccacgcggttgcgcgcctgagcgatacagctacgcaagttcagcgaggtccgacgttcttcatccataatgcccattttcagggtattcggtgccataccgagcattgtctcaatgcgggtaaacagtttgttggcgaacgccacttcctgcggaccgtgcattttcggtttcacaatatagacgctgccagtgcgcgagtttttctgcacttttaaatcatagagggcaatcgcgccagtcatgacgccatcaagaatgccttccgggatttcattgccttcgctgtcccaaatcacaggaatggtcatcaaatgacccacgttgcggataaacagcagcgagcgtccgtgcagagaaatttcagagccatcggcggcggtgtaatgacgatcgtcattcagtttacgcacgatttgccgaccgtttttctccattttctcttgcagagtcccctgcatcaggcccagcaggttgcggtacagcaggattttatcttccgcatcaaccgccgcgaccgaatcttcgcagtcgagaatggtactgatagcagcttcgacgataacatcgttgatgtgcgccggatcgtctttgccaatccgcccattggcatcgatttgcagctcaatatgcaggccgttatttttcagcaaaatgcaggtcggcgcagcggcatcgccacggtaaccgacaaactgtgctggagtacgtaacgtggtttctttaccatttttcaactggatgcgtaattgtttatcaaccaccttaaacgccaccacatcctgatagctgccgttttccagcggtagagattcatcgaggaaacgccgaacccaggcgataacctgctcaccgcgttgcggatcgtagccgctgaccatcgccccttcctgcgggatgatgtcgctgccgtataacgcatcgtacagtgagccccagcgagcgttcgccgcgttcagcgcgtagcgggcgttcattgccggaaccaccagctgcggccccgcctggctggtgatttcgctgtcaatgcccgtggtttccaccgtcacgcgctccggttgcggcaccaggtagcccagttcacgcaggaaagatttataggccgctttatcttttaccggccccggattgctgcgatgccactcatcaagcgctgcctgaatgcgatcgcgttctgccagcaactgacgattttctggtgccagatcatgaacgatctcatcaaaattgcgccagaacgccgcagcgtccagccctgttcccggtaaaacttcttcatccacaaaacgtttaaaattggcgtcaatgcgtaaacggctctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccgccttccagcgacgttaataacggcgcagtcacgaacgcggtacgtccgttgttcaccatctcttcatagcccttagtttcacgacgccccagcgcggcggtacgcgctttctcctgggagatataagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagcaacactttttccacttcgccgttcagcttttgcgcatgttgtagggtacacggacagtggaaggccagctttttatcgccgcgaattgccagtttttccagcggttcctcgcgcagaagttcgactaaatcgaccgccagttcactgacctgacgtgctttatcggcatataacgcatcgtttttcagcatctgcccatactctttgacaaacgcgccgcagccgctggcggtttgcaaaattgcctcggcacctgcttcaatcgcgggccaccaggcatcaatattattgcgcgcccgtgccagccctttctcctgcgcattaagatgatagtccaccgcgccacaacagcctgcttcgttagctggcatgacgctgatccccagacgatccagcactcgcgcagttgccgcgttggtgttgggcgaaagcgtaggctgggcgcagccttccaacattaaaacccgacgcttatggcgcagcggcggacgcggtttagctttcaccgtttcagcaggcagttttgctctgacctgttccggtaaaaacggtcgcagcaccagccctacctgcgtcagcgcacggaagaccgccggacgcggcactacctggcgcaatccttcgcgcagtattcgctccggcagtgggcgtttcactttctgctcgacaatatcacgcccgatatccagcaaattgtgatagcgcacaccagaaggacaggtggtttcacaattacggcaagtgaggcagcgatcgagatgctcctgtgttttaagcgtgacttcgttgccttccagcacctgtttaatcagatagatgcgcccgcgcggcccgtccagttcatcgcccagaagctgataggttgggcaggttgcggtacaaaatccgcagtgaacacaggcgcgcaggatgctgtcggcttccagcgcgcgcgcgttctgccgcatctcttcagttaattgggtttgcatagcctgctcctcaaagttccgcgtacatgcgaccggggttaaacacgccgcaagggtcgagctgctgtttaagctgctggtgatagcggaataaaggagccgatagcggggcaaagccaccatctccggcactaaagcgggtcgcatgaccgccagcgttgcgggcgatgcgatggatttgattgtcctcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgaccggcaacctcttcgccacccagcagttcacgcgctgcttttaccgatccttcgccgccctcaaggcggatccacaacgcattgtcgaagtaacataagccactaatgggtaatggctggagttgccactcggcgatttcactcatggcttcttgcaggctgatttcccgacgcaggctcagggaggcgcgcggtcgcggtaacactttcattgagatttcagtgagcacgccaagacaaccgtagcttccgaccattaaccgtgagagatcgtatccggcaacgtttttcatcacttcgccaccaaaacgcagatgttttccagcgccggtaatgatgcgcgtgccgaggacaaaatcgcggaccgaaccgctccacgggcgacgcggccccgccagcccgcaggcgaccatcccgccccaggtggcttcttcaccataatgcggcggctcacaggggagcatttgccccgcgctttccagcgccgcttcaattgtcaccagcggcgttccgacacgcgcggttatcaccagctcggtcgggtcgtaattaacaatgccgcgatgacaacgaacatccagcgtttgcccggtgacagggcgacctaaaaaggctttgctattgctgccctgaatcaccagcggcgttttatcgctaatcgcctgattcacctgctccagcagcgcctggctgtaatcacactcgcgtagcatcagaaacgctccagttcagggaaaggtaaatgaccgtgatgcacatgcatggcaccaaattcagcacagcggtgtagcgtgggaatgtttttcccagggttcagcaaaccatcggggtcaaacgccgccttgaccgcatggaaggtcgtgatttcatcgctgttgaactgggcgcacatttgattgattttttctcgcccgatgccatgttcgccactgatgctgccgccaacttcaacgcagagttcgaggatcttcccgcccagctcttccgcgcgggcaaattcaccgggttcgttggcatcgaaaaggattaacgggtgcatgttgccatctccggcatgaaagacgttggcaacacgtaaatcatattgctgcgataaacgggcaatgccttccagtacgccaggcagggcgcgacgcgggatggtgccatccatgcagtagtaatccggggagatacgtcctaccgccgggaacgcatttttgcgaccggcccagaaacgtacgcgctctgcttcgtcctgtgccagacggacgtcagtcgcgcccgctttcaacaagatgtcgttaacccgctcgcagtcttcctgtacgtcagactccacgccgtccagctcgcataacaaaatcgcttcggcgtcgacgggataaccggcatgaataaaatcttccgccgcgcggatcgacaggttatccatcatctccagcccgccggggataatgccattggcgatgatgtcaccaaccgcaagtccggctttttctaccgagtcaaagctggctaacagaacccgcgccacgggcggcttcggcagcagttttaccgtcacttcggtggtcacgccgagcataccttccgatccggtgaacagcgccagcaggtcaaaaccaggtgaatccagcgcgtccgatccaagcgtcagtgcctcgccgtccagcgtttgcacttcaattttcagcaggttatgtacggtcagaccatatttcaggcagtggacgccgccggcattttcagccacattgccgccaatggaacaggcgatttgtgaggaagggtccggtgcgtagtagagattatgcggtgcaacggcctgggagatcgccaggttacgcacgcctggctgcacgcgcgcgcggcgaccaacggggttaatgtcgaggatctctttaaagcgcgccatcaccaacaacacacctttttccagcggcagcgcgccaccagaaagcccggtgcctgcaccacgggtcaccaccggtacacgcaggcgatggcagacagccagaatcgctgtcacctgttccatttgcttaggcagaacaaccagtaatggacgcgtgcgatacgcgctcaacccgtcacactcgtaaggaatgatctcctcatcggtatgcaggatctcaagtccagggacatgctcacgcagtgccatcagtaccgatgtgcggtcgacatcgggtaaagcgccatcaagacgctcttcgtacaagatgctcatgagtaggcttcgctttgttgtgttgtgtggcagctgatttttgcgcgctgcttctgtgaacagttattaagcgggcttttcgttttcgtctatctctttagctaccggtcagaccattttttttccagctctgtgaccttgtcttggttaactcaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtactgaaggtcggtcagccgcttccctcggaacgtcgactgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacaccagcccgctgatccatctgttcagtacgcagccgcgaacgctgtacgatctgctcgacgttcgcgcattactggagggcgaatcggcaaggctggcggcaacgctgggaacgcaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgatctgatgtttaattcagtgtttgccagcgtaaataatctctaccatcgaccacagcaaaaaaagcagatcgatcgccagcatgcgcggatctacaacgcggtgttgcagcggctgccgcacgtcgcccagcgcgcagcacgcgatcatgtgcggaccgtgaaaaagaatctccacgatatcgagctggaaggccaccatttgattcgctcggcggtgccgctggagatgaacctgagttagctggtattaaatctgcttttcatacaatcggtaacgcttgtacggctccgccccaatgcgttccagcatgttattcatgcctgtattggtttcgaggatccatgacatctccagcgcatcgatcttccggcgggcaaacggatcgcgtaaggcttcaatcaataacagcgcaatcaccgggccgatgcggctgaactgatactcgtcgcgcacgcccatcagcggtactcgcgcagttcgcacaccgctgactttcaaacgccacagcaattttgcccagccgaagggaaagagcgatccgttcagatcggcaatcgcctcgttgatgttcggcaagccgacaataaacgcgcagggtgcagaatcaatctcagcgatatagatcatatcgtccggcaccagatatttaagttgatcgcccatggtcgcgaattcatgttcggtaaacggcacaaatccccagttgtgctgccagccagagttgaaaatctcacgcaggatctgcatctcttcggcaaaccgctgacgattgatgcagcgaatggtcacctttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggtggtgtgtcaaaaccttcaatcagtaatccgctttcctgattgatattcaggctgaaaggaccgctgatcttacttgcaccttgtgacttcaaccacgcttccgctgcgccaaacaacgcggcaaaaacctgcggatcatcaatggcgtcaatcatgccgaaatgaccggtatctttgccgtaacgctcgcggtgcaaggtatctatttgcgcggtaatacgcccaactatctgccccgctttttttgccacccacgcctgccagatgatatggtccgtccccggatttttcgcagacaaatgctcgttgcgttcaatgaataaagggggtatccagtttggatcgtcgggataaagtgatgacggaaaagcgataaatgccttaaggtcatttttattaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaaatcaggtcatacgcttcgagatacttaacgccaaacaccagcgaaatgagcggcttgccgacgatcaacaccgcgagcgccaccagaataccgattccgcccgccagtaaaccggacttcacacctaacaaccacggtctggtggtgcgcggatctaaacgcatcacctctgggtaaaaacttttacccagcaaacccgctggcgttccggcggcgtcgaagaatgtcatggcgattttaaataacccggcggcagcgggtcctaacacgatccccaccaacactgtgctgcacgagttacgcgccgaccagatggagtgggcaatgttggttgaccagacaaaactccacgcgcctttaatgtatcgggcagactcaaacagattcaatttgaaggcgttatggatatttcggcggcgtaattcgcgcgcggcaaaccaccagtacatggtgccgccaaccagattcgacacgtaccaggcaataacaaaacccgcaaaaccaaagtcaaaataccaggctacgacgctccccgctgcgcgcagaaaaggtttcgtcgcctgctgtacagcaattaaatcgaagcgatctaccgcacgcagaatgccggtcggcgtggaggaagccattgaaggaatgagcgtgcaatagagcgctgccagccaaaaactttggtcatccagacctaatgaatgggaaaggaatggcagtaaggcaatgccaccgacaatcgccaccgcgccgctgacgatatccagcgagaaggaaaatgagacgacattgcggaattgctgcggattattgttggttaatgctggtgttccgtactgaaccaccagttgccatgtctgaaacttaataaaatcgctgatcgacttggcgtacgattgcacaatcaccagtacgccaaacatggcgggcgtcatccctttaccggcacacgagagcgccaacagacccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcttcgacatgacaccgattttgtcctgcagctcggcatagtcatggtcaggcttgcgggagatggcagtctcaatatcaatgcccaggcgaataattaattccgggcgatattgcgccatttgttggtataaacgccgttcgcgctgcgccagaaacatgctgattttcccggtcgcacgttcgacgccaatccccggtccatcataataaaagcccgaaatttcagcctgcgggaagcgatcgctgaccaccagaacgccactttgcgccagtcgctgaaccttgcgtagattcgccattcttcgcagcgagaagcagtacataatcaccgccgcccatagcgccggagatttggttttcatgctttgggttttcgaggatttggccgccagtcgccgttccagccagacgccaaccaacggcaatcgtttgattttgtcgccgtcttcgccggagagcagccccagatagcgccgctcggtttgccagtgttgttgcagcgatttcaccaggtcggtggtcagtgtggatttaccggtgccatcacacccgaccaccgcaatcagccccggaatgtagttgggctgcggcgcggttgtactattaacagtttgagtttgtagtgcatccattcgttaaatcatcccctatccattttggtgatcaggaaagcgcggcgtgaattgcgcgtagtgacgcttgcagaatttcatcggcggggtgtcgcccatccagttcaaggatctttgcgccattgaatgtcagttgcggcgtaacggcgattttttcctgtaacgctgccagttggtggtcaggtttacgcgcaaacgcggtttgttcatcaatgccaagacgaatcaacaatacgggcaaataagatgccatccattggtacagcttcagctcgcgctgccttaacatttttatccaaccgttaccgcccgtggtttttgccaattgcgggccatcaaagcgaaaccccggcacttcaacctgcgggtagcggtcggtgatgagcagaaagccttgctggcttttacacaacattttgcgaaacttgtacgcccgccagcaggaaagcagatagataaccagtgcagtaatattgccaggcggtgttgagggcttttcgtgcacatgtgccgctttacttcgcagataacgcccaaaaggtgcgccaataacagggagctgtgaaatccattcgccaattcgcccggacgattgcccgagataaatgtgttctgttggcattcttgctgccagttcatttaccaggcttgccgtgagggtcgatttacctgaaccatcacatcctacaatggcaataacacgcactggcgtggaattaattattgacatattacgttgattcacgaaaaacccggcagtaaataatgtattgaatattacgtggtccgtgctcagaatatccgttcaaccttattgtgacaatggttaattgtgacattgacctgaattacgctttcataaaaacatattaaccaaataaatatttttaatggatatttaaattaaaggatatattcatgcagtcaataacacctccattaattgccgttattggtagcgatggttcaggcaagtcaacggtgtgtgaacatcttattaccgttgtcgaaaaatatggtgctgccgaaagagttcatttaggaaaacaggccggaaatgtcggtcgtgcagtgacaaaattaccgttgatgggaaaatccttacataaaacaattgaacgaaatcaggtgaaaacagcaaaaaaattgcctggaccagttccggcgctggtaattacagcgtttgtcgcccgtcgcttactgcgctttcgtcatatgcttgcctgtcgtcgtcgcgggttaattgttctaaccgaccgttatcctcaggaccaaattcctggcgcttacgatggtacggtgttcccacctaacgttgaaggtggtcgttttgtctcatggctggcaagccaggaacgtaaagcgtttcactggatggcgagccataagcctgatctggtcatcaaactcaatgttgaccttgaagttgcctgtgcacgtaaacccgaccataaacgggaatcgctggcgaggaagattgccataacgccacagttaacctttggtggtgcacaactggttgatatcgatgccaatcagccactggaacaggtgttggttgatgcagaaaaagcgattacggattttatgaccgcgcgtggttatcactagtcaaaaatggaaatgcccgatcgccaggaccgggcattttcaggaaggttaaatcaactgcaatgctatccagtacagcccaccagaaagaaaaattgccgccggtaaagtaaatacccacgccatcaggatgctggttaccgttttacgctgtaacccaccgccgtccaccaccatcgtccctgcaactgcagacgagaggacgtgtgttgtggagacgggcatcccaatataactggcaagaccgatagacactgccgccgtcatttgtgccgccatgccttgcgcatacgtcatgccgcgcttaccaatcttctcaccgatggtcatcgctacacgacgccagccaatcatggtgccaatgccgagcgccagtgctaccgccatgatgatccacaccggagcgtactcaatggtgcttaacatatcgctgcgaagttttttcagcaggttctggtcttctttactgacgcctggcagtttcgctagcttcgcggaggtatcagagatgcacagcataatgcggcgcagctggctgcgctgactcacgcttaacggctcgtaactttccatattgcctggcagcatcgttttaacgcgcgcaatagcatcaaaggtatttgccggatgacagtgaaactctgttacttgcgtgccatcagtcgatgctgcaggcaatggaggttccatcgcaatcaacttctgcggcagttcaggatgctgttgcaggtagtgttcgaagttggtaacggcatcgcgggtacgggtaatttcatagccggacgcattcatattgacgacgaagccagcaggggcaatccccaccagtaccagcattaccaggccgatccctttttgtccgtcgttcgcgccgtgcgaaaacgccacgcccgcagcggaaacaatcagcgcaatacgcgtccagaatggcggtttacgtttgccttttttctttttgcgatcttccggaatgcggtgaatacggtcacgctttttcgtcccgctccagtagcgtcgcagcaggaatatcaggcctcccgcaatgaccaggccgacgataggggaaacaatcagcgaggagaaaattttggtcacttcacgcaggtttaacgcatccatcaccgatgagccggttaacagcgcgttggttaaaccgatgccgataatcgcaccaatcaaggtgtgcgaactggaggccggtaaaccgaagaaccacgttcccaggttccagataatcgccgccagcagcatggaaaagaccatcgccaggccgtgggttgaccccatattcagcaacaaatcggttggcaacatatggacaatggcataggcaacgctaagtccgcccaataacacgccaaaaaagttaaaaaatgccgccatcaccacagcaagttgtggttgcatggcacgagtataaataacggctgccaccgcattcgccgtgtcatgaaaaccattgattgcttcgtagaacaacacaaatgccagagcaagcaataacaaaagccctgtgtatatatcaaggccaacaaataaatttagcatatattagattacgccattttgaatttacgaacggacgcattatcagtgactttaacggcatgggcaaagtgaaatatcattttttaacgataaaaagagtgttatttcttgtgtatcagacaataagcattcattcaaaacctttagaaataatcaaaacacaggtattccactggttaatatattcacatatgaaatgaataaatattggaatatataaatattgaatattttgattaatccccgtactgattattcttcataatcagtacggggttgctacaacatgtattactttttcaccacaattaacggttcaatatcactctcttttttgatgaccagtgattcatcaccgcgcaaacacgtcccaccgtagttgccgccaacggtgaaggtacatacctgaatgtatttaccgtccactttcggcaaacaccacagttgctgatagatgtttttctgctcggcaaatttaccgctggttttgtccagcacctcttcatgatggctgacgaggtcgatattgctgccacagcgaccggcgatcggtttcactgcgtaacctgttttcaccagttcatcattaacagtgaaatcggtatccagcaggtaacgatggtgcgggaacagcgaccagaggatcggcagaatcgctttgttgccggggatcaccgtccacagcggctcaaagaccagcacttccgggcgcagcaatacgtcgataagacgcacttcgttttgcggatgaccggtacggattggcaccgcagcaaactcacggtcgctaacttcacgaatctgatcaaacgcggtttcccacgcccaggttttccacacgcagttaaccagtcgcccttccccatcaatcagttgcccggcagcatcccagcccagttcatccaatccacgcaagatacgcgtttcaaagcccgcctggtgcagcgcctgctccataaactgcgcgtgatagttttcctcgatatctttgtcctgcatgatatggacaaacggacgtgcacgactgtgtttccaggcaccagccaattcgttaatcagcccttccgccggattgaagccgttgcctttatagccctgctccgcccaacgttcgaggatcaagcccgcttcggtatgacaggaggcggagtcggcgttgtactcgtaaaccttcaggccacgctcatccatgcagaaatccatacgaccagtgatcatatggtgacggcgacgctgccaggagagacgcaaacgtggccagaggattttcgggatgtcgaacagcgccagcaggttgtcatctttcagcaccttgtcggttgcgtgaagatacatcaggtgcagctcgttggtggctttaattagctcctgctcggcactctcggtaatggtgtagtaatgataaggatcctgattgatcacctgaccgttggcctgcacataggcgttttgcagcggatctttttcatccagccatttaccgtcaaactggcctttgttttccaggcgcgctccgctgattttcagcagctcgcctgcaatttccggctgcggtaagctgtattcagtatcttccgtctggatcatccagcccagaatggtggtgtcatcaaaagtgtctttcagggtatagcagccgttttcgaccaccatctccagctcgcgcgtccactgttgcccttgcggcaacggggaatgaatcacgttctgttccgcaatacggactttgttgccatgcaattgggtaatgatggcgacatggccagtgtctttaaattcaccgcctttatcccagataagaagcgcacccgcgaccggcgcacgcggcgagccgttaggaaatgcctgcaatggcaggatgttgtcattaaccacttctcgcaggaagcgcagcgagaaaatctcccacgccatacccacgtcagtaaagaccacaccgtaattcagaaagagaaaacggcgagcaaattcaacgcattgccacttgtggcccatatattcgtcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgcccgttggcaaacacccattgcaactttattcgctgggaacgccgaacggtcagaaagtaacgattatgcttgaggagctgctggcgctgggcgttactggtgcagagtacgacgcctggctgattcgtattggcgatggcgatcaattctccagcggctttgtcgaagtgaacccaaactcgaagatcccggcgctgcgcgatcatacgcataatccgccgatccgcgtgtttgaatctggttcgatcctgctttatctggcggagaaatttggctacttcctgccgcaggatttggcaaagcgtactgaaacgatgaactggctgttctggttacagggcgcggcaccgttcctcggcggtggttttggtcacttttaccattacgcaccggtaaagattgagtacgccatcaaccgctttaccatggaagccaaacgtctgctcgacgtgctggataagcaactggcgcagcataagtttgttgcgggcgatgagtacaccattgcggatatggcgatttggccgtggtttggcaacgtggtgttaggtggtgtgtatgatgccgctgagtttcttgatgcgggcagttataagcatgtacaacgctgggcgaaagaagtaggcgaacgtccggcggtgaaacgtgggcgtattgttaaccgcaccaacggaccgctgaatgagcagttgcatgagcgccatgacgccagtgatttcgagacgaatacggaagataagcgtcaggggtaagggttggtgttcgtcgcagcaagccatccaggccggataaggcgttcacgccgcatccggcaatcgtgcacaatgcctgatgcgacgctgccgcgtcttatcaggcctacgaaagctaatcatcacgcgctggtaatgtcgtaatccatttggcgcagtgcgtctaatgtggctttggcttcatcttcgtcgatgatgctcatggcaaatccgacgtgtaccagcacccactggcccagtagatcggcagggttaccttcacaaatcagggcgatattcacatcgcgcttgataccacatacttcaacctgcgcaagctggtgaatatcttcaccgacagccagcacctggcctggaacgccaatacacattattaactccggttattcaacttcaatacttttgacgatcagcgaatcgccggtatcgacacgcaaccgctcgccgtgacagagcggacactgcgcatcgtgctgatgaatctccaccacctggctgcaatcccagcaccaagcctgggcgggtttatagacgatatgtaaatcgcacccttgcgccaccgttccgtggcagacaatttcaaaactaaaacggacggcgctctcctcaacgcaggagagcgcgccaatttccagccacacggcggtgacgcgcttaacatcgtgctgctccgcctgccgttggataatttcaacggcgctctggcaaagagacaactcatgcattttcgccactcctgcgaccaaacagcagggcgcgacgccctgcgtgtggtacatccggattcgtgactggcagcgaaaggatcattcgtgcgcagtcatccgtcaggcgttggccctcttcaatcgacatgctgtgcgaaagcggcgacatcagcgaacaggagagatattgcgaaacaccgtccagttcgccaacggtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaaatcagaaacatacaccggcattgaaggatgcagaaaagagagatcgtgcatcgaacgccgggcaatttcttcaaacgctgcctgtacttgcgccttcggggaggtctggaaacctgctatctcttcagtcatgaatcgcctcccgtgggatggcttccacgccagattcacgcagcgcagccagaacctgctcaagcgcaggttcaatcattgcttcaaccgtcggcgttaagccgatgtgtggctccagcgattccgggatcacgccgaccagggtcagctttttcggaaactcgccggtgaagcgcagggccgacaagacgtcggccaggccaagctgatgcggagagattttgttggtaaacaacgccggaacttcttcatcccgcaggatcatcatcgttcccggcgcgttctttttcgagacaatggcatccgcaataatcaaatgatcgcgatttgccatgtcgccaagcagctccattcccgccgtgccgccatcgaggatctcaacataatccggcagaatgtatcgttgctctaacgcttcgacaatccgcacaccgatggcttcatcggtcagcaaaatattgccgacccctaagactaaaatacgcattacagaaccttcactgaaaccacttcgttgccgtcagcatccactacgtgtaccgcacaggccatgcacgggtcaaaggagtgaatggtacgcaccacttccagcggtttattcggatcggcaaccggtgtacccaccagcgactgctcgtaaggaccgacgtcatcattgaagttacgcggaccagagttccaggttgatggaacaaccgcctggtagttgctgatgataccgtctttaataaccatccagtgagagagcataccgcgcggcgcttcgaggaagccaacacctttgaattcacccgttgccggaatgttcggcttcacaaaggtggtgtgatcgcctttgccgatattggtgatcagtgcactgtattggttttgcaggatatcctgcaattcacagcagtgaacggtacgaccaataatacggcccagcgtggagtgcagctgtgccacttccagcgtgttgccagtcagtttctgataaatcgcaacgatttcattcagtttgttctgggtagattcgcgacctgccgccagtttcaccagcatattagccagtggccccacttctaccgttttgccgtagaaagtcggtgatttcacccaggaatatttcccgtcgtcagaccaaccatcataagccggaatggtggtgccttcccacggtgcctgcggcgcttcgtctttataccaggagtgcttcgcgctttcctgaatgcctttgatcaggtattcatcggaatgagaagtgatcggacgatacgaggacagatccgcattctcaatgtagccgcccgggaacaggaagctgccgtttttactgtcggtcgggaattccggcacgctcaggtagttcaccgcacctttaccgcgtgtcagccattccgggtagaacgcggcaataactgcggtatcaaccttataaacctgctcaacaaagtcgctcagtttgtcgatgaaagacttgatgtacatcaggcgctcaaggttcagcacgcccaaaccgtcgaggttgatcgggttcgcgacaccacctaccgccaggttctgaatgtgcggcgttttaccgcccagcagcgccacgacgcggttagcgtcacgctggcactccaacgcttgcaggtagtgcgctaccgcaatcaggttcacttccggcggcagtttcatcgccggatgaccccagtagccattagcgaaaatacccaactgaccgctggcaaccagatctttgatcttgttctgaactttggtgaactcttccggactgttcaggtgccaggtcgaaacgcctttcagcatttcggaggctttggttgggtcagcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccctcaatacgggttaccggatcaatagtaattctctggctcatgctttgctcgcctcatgacgattatgatcgttttgttttaaaggaggaagtatcggcagtagacgaatgagtacgatgtaagcgcaaatctcaatagccacaaaaccaatagaaatcaacagttcttcccaggtcgggaagtaggcgtaaccgccgcccgggttgaatgccaccagcgaataggtcagacgccaggttgcacaacctaacagtgcgctcagtgctgacaggaacagcatgcgggaatcattacgcagcttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtgttggtcagcttaacaaacagactcttttcatccggaccgttgccacgcagacccgcctgcaccagcgaaccttcaaagatgacaatcgagaagcccatgatgaacgccgtcagcagcgagaacagcggcaacatttcatagctctgccacaacggatgcaccttgtagcccgccgagatcatcagcgaccccattgaagactggtgcatggtcggcagcagcgcaccgagcgcgatgatgaagaacatcaccttgtttagtcgctgtagcgacaccttccaccccagacgttcaaacagtgccggagcaaactccagtgccatcacgccgatatagatggtcatacagaccgccgtctcgaacagtaccgagttcacgttgaagtgacccggaatgtagaagtacggcaggttccagtagcgacccacgtcgatagtgatcgacaagccacccagtgagtaaccaaacagactcgccaacagcgccggacgcaccagcggatggtattgcccacggttaaagacgtataccgcccacgccagcgcccagccgccacaggcaaagccggtgccaatcagcaggtcaaacgcgatccacacgccccacgggaagccgccgttcaggtcagagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttggtgttgcgacgaaccagcacggttaagcccgccagcacagccagtggtagcatcatgcctttatacagggtgtgttgaatattttcggaacgcgcaccggtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgccaggcttcagcgccagacgttttttcgcctccgccatcagctcttcacgcgtaccgaaaatcaccgcgcccgccgggcacacttctacgcagccaggtagaccgcctttatcgagacgttccacacctttctggttgcacagctcgcacttatgcagcgcaccaaacgggttgttgtagtcgtacttcggcacgttgtacggacaggcgaccatgcagtaacggcagccggtgcacacatctttgtcgtaatggacaatgccggttttcggatcttttttcagtgcagagaccgggcacacagagacacagttcggatcgacgcagtgcatacactgtttcttaatgtacgcgtagccgttctcctcctggtctttgttgacccctgtgccgctggtccacacctgaatgatgttattggtatacggcgacagtttgtcgttgttcgaccaggtctgttccccttgcgggttacgttcagggaaattgatatcctgacacttggtgacgcaagcctggcagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccaacccaaccacaccgccgagcaaaccaatagcgcctgcagagacgttgccgccctctttagcgttaacatccggtttctgtgaacgcggagtttgattttcgacgttggcaagctgatggatgcctttatggaagccgataccttcttcgttacagccatagcaagggtgaccaatcgccaccggccacacaccgccaacatcgcagaattgcagcgttgagcagttgccgtaagtttctggccctttacagccgaggtggtacaggcaccagccttcgcggtggccttcatcaccgaactctttggcaaaacgaccagcatcgaagtgcgggcgacgttcgcagtgttcgtgaatcagacggccataggcgaaggtcggacggtttttgtcatccagtttcggcggtttgccgtaagtgatgatgtgcgcaacggtcgcgaggaagttgtgcgggttcggcgggcagcccggaatattgataacggttttgcctggcagaacttcttgcaggctgactgcgccagttgggttaactccagctgcggcaacaccgccccacgcagagcaggaaccgatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagtacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcgctaaaacgaagggaagaagcattagtgtaattaattaaagcaagataatacgtatgtttgatcaattttcgaggcgataaccggccataaaaaagcgcaacgtagaacaggaattattctcacgaaagaaatccattaccatctctttatccagtccatagcggcgcgtcagaatacccgcttcccaggcgctaagctggcgatctccggtcttttcgtacatccggtgtgagtagcctaatacaaaaccgcgtttataatcggcacagaattttgtcacattaaccgcactgtcggcatgcgttgcttttaatcccgccattaagcctttaccaaaatggttattcatcgttcacctcattcgctatatattgtcatatatagcgatattttaggcaaagaacgacttttgcgcacgctattttttcatgcttgtttaagacgtaatcccgtaagagataaacctatcaggagagatatttatcgaaccatttcagtgtcctttgccaggcaagatcggcggcagatttgtcataacggggcgtggaatcattatggaatccgtgattaacccccggatagatatacgcctcataaaccttattattggctttcaacgccgcctcgtaagcaggccagccctcgttgattcgggtgtccagttccgcgaagtggagtagtaaaggcgcttcaatcttcgccacatcggcagtgggtgcctgacgaccataaaacggcaccgcgcaggccagttccggatacgcgacagccgccgcgttcgatacgccaccgccatagcaaaatccggtaatacccactttgcctgtcgcttgcggatagcgttgcataaactcaattgcggcaaagaaatcattcatcagtttgttggatcaacctgctgttgcagctcacgacctttatcatcatttcccggataacctccaacggaacttaagccgtcaggtgccagggcgatataccccgccttcgccactcgccgtgccacatcttcgatatacggattcagtccacgattctcatgcaccaccactacggctggcgttttgccgctcatctttgcgggcttcaccagataaccccgcacctcgccgtgaccatttggcgaaggatacgtgatgtactcagcaacaatttccgggtcggtaaactctacctgagtcgccagcgcataatttggcttgagcaaatcaaacaacgctaatgccgtcatcccgcctaccgcacttcgccgcaaggttgaggaactcacgtttcgagattttcccgtgagcgtaatagtcatagtaatccagcaactcttgtgggaaatctttggcggttaaacgcggcatcgttgcactcctcagttggtgtttttttaagcaaagcataagcacgtatttttgcccagtttttcgtcactctgtgagccagactacgggatacgcgctggcgaatcgctaaactagaaacattgtttcgaaattgaacggtggaaaggagaggtcatggtctggttagcgaatcccgaacgttacgggcagatgcaataccgctattgcggaaaaagtggtttacgcctgcccgcgttatcgctcggtttatggcacaatttcggtcacgttaacgcgctggaatcacagcgtgcgatcctgcgtaaagcgtttgatttgggcattacgcactttgatttagccaacaattacgggccgcctccaggaagcgcagaagagaactttggtcgcctgctgcgggaggattttgccgcttatcgcgatgaactgattatctctaccaaggctggctacgatatgtggcccggcccttacggctctggcggttcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgtattgcctttactcctctggctcagggattgctgaccggaaaatatctcaacggcattccgcaagattcacggatgcatcgtgaagggaataaagttcgtggtctgacaccgaaaatgcttaccgaagccaacctcaacagcctgcgcttattgaatgaaatggcacagcagcgtggacaatcaatggcgcaaatggcgttaagctggttgctgaaagatgatcgcgtgacgtcggtattgattggtgccagccgcgcggagcaactagaggagaacgtgcaggcgctgaataatctgacatttagcaccaaggagctggcgcagattgatcagcatatcgccgatggcgagctgaatctgtggcaggcgtcttccgataaatgacctgttaataacgggcgcgcgaaccgcgcccgaatcagatcagtgattatgacgagtcagtcggtcaagatagcccatcacaaatgcagaaagcacaaacgtcagatggataatgacgtaccacatcagtttgttatccgggacatttttcgcatccataaagacgcgcagtaagtgaatggaagaaattgccacaatcgacgctgctactttgtttttcagcgacgttgcgtccattttccccagccagttcagcttctctttgttctcggagatatccagctgtgagacgaaattctcataaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccagggcaactaacgccagcgaaaggccaaagtacacgggggcaagcagccagcgagaagcatacattgcattttcaagaaaacgttccatacattcctgtcgtgtagttaaaacgggcaacagtatatcgcaattgagtaaacagcacgcaacagcaaatcaacatatacgttaaacctttgtcgcataattctgaggtttagggatcttcctggttcccttatcaacgcatcgagaacgtctacccttaaaggacgttgaacctgaagggagaaaaacgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaaaaaaatgcccggttgtgaaaagcaaccgggcatcattgtgaattcactcttacctgatgtggcgaaaacgccttatccgcctacaaacgcatgaagattcaacatgttgcaatagattttgtaggcctgataagcgtagcgcatcaggcattgagcacctaatgccggatgcgtcgtgaacgccttatccggcctacaaacgcacgaagattcaacatgttgcaatagattttgtaggcctgatgagcgtagcgcatcaggcaattctactttacttcgctttggcggtttcttcgccgaccagacctatcttcaggtaacccgcctgatgcagcgtatccattaccttcatcaacgtctcgtaatcgacggttttgtccgctcggaagaagatggtggtgtctttcttgccttcggttaacgcattcaacgccgtaatcattgtttcatcggtgaccggatcgttaccgataaacatcgagttgtctgccttcaccgacagataaaccggtttttccgggcgcggctgcggcgtgctggtagaagcaggcaagttcaccttcacatctaccgtcgctaacggtgccgccaccataaagataatcagcagaaccaacatcacgtcgataaacggcgtcacgttgatatcatgcatttcgccgttatcgtcgaggttttcgttaagatgcattgccatcggatattatcctgcgcgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcgatacccggcgcaacgactgccaggttagtggtctgcgtttgcgcgataccaataaagctgttcatgatgccccagaccgtaccaaacagaccaacgaacggagaaatcgcgccgatggttgccagatagccgttaccgcggcccatttgacgacccactgcggcgacccgacgctccagacggaagctggtacgttctttaataccttcgttatcgtcgctgccttctgacagttccagctcattctgcgcttcattgagcaaatgcaggcttaagcttttgctaccaaaatcagcggcgatatcgttggcctggtttaaggaacgcgcttcagccagcagttgctgctcgcgcttaaggcgacgcttctgattgaagaactctacgctcttactgaagaagattgcccaggtgactacggaggccaaaataagcccaatcatcacgcacttaacgacaatatcggcgtgctgatacataccccagacggaaaggtccgtctgcattaaattattacccactgtgtatctccaggacgcaagtcacaaaatctgcgcataataatatcaaaacgacgtcgaattgatagtcgttctcattactatttgcatactgccgtacctttgctttcttttccttgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataacattgccacttttggacaattttgcagacattttattgtgaaaagtcttaaattgttgcgtccgggatcaaggcgtcccggacgattcaggagtacaataggcagataaaggcttaaacgctgttccacaggaaagtccatggctgttattcaagatatcatcgctgcgctctggcaacacgactttgccgcgctggcggatcctcatattgttagcgttgtttactttgtcatgtttgccacgctgtttttagaaaacggcctgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagtggattgctgtgggtcagcgtggtaaccagttttggctatgccttaagtatgattccgttcgttaaacgccatgaagatcaggtaatgacgttcctgatgatcctgccaattgccttgttaaccgctggcttgttaggcacgctgtttgtggtgattaaaaaaaaatactgtaacgcctgacgattttccccgttcccggttgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgctgctgcgctggccttcatgccgtcatggatgatcatcatccgcgccttatgcagacggtaattcttcaaatactgcaacggcgaggtactggtgacagacttaaaattatggtggaacgccgatacgctcatgttggcttctgccgccagttgctcgacgctcaggttttcggtgtatttattctcaatccgtttcagcacgcggctaatcagactgaagtgagtctggcgactgaccagcgccagtaacgcgccgccgcaaggtccggtcagcacgtagtacagaatttcgcggatgatctgtttgccgagaatacgcgcatccagtggtcgctccatcacgtcgagtaaccgctccgccgcgcataaaatctcttctgataacgtggcggagttaatcccgctggctgccatcgacggctggaaatgctcatcttcgccaatgtccatcaacagttcctgtaactgcaaaatatcgacattgagacgcaaccctgccagcggcacctctgacgtggcataggtttcgcactcaaacggcaacggcaccgtcagcagcaggtattcattggcatcataacgaaacacgcgttcattgatataaccgattttatgcccggaaaagagaattatgatgccaggctcgtacatcaccggtgtacgtgcgaaaggcgtctcgccatacaacaaacgcacatcgggcaacagtcctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagagccagggcgctggcgatcacaatgaaaaacatcaggcagatcgttctctgccctcatattggcccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaacatgcaaattctcccggtggcggtaatgttccgctaccggacttttcagaaatcatttattcccctcgcgtcccgcccgttgttactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgggcgataacttctgcgcgtattcaacaggcgcttaccctgaacgacaatcttacgctgccgggcaatattggctggctggattatgatccggtttgtgattgtcaggattttggcgatctggtgctagaaagcgttgcgataacccaaactgacgccgatcatgccgatgccgttgtgcgctttcgtatctttaaagatgataaagaaaagaccacgcagacactgaaaatggtggcggaaaatggtcgttgggtcattgacgatattgtcagcaatcatggcagcgtcttacaagcagttaatagcgagaatgaaaaaacgctggccgctttagcttcgttgcaaaaagaacagccggaagcctttgttgccgaactctttgaacatattgctgattatagctggccgtggacgtgggtggtttccgactcttaccgccaggcggttaatgccttctataaaaccaccttcaagacggccaataatcccgatgaagatatgcaaatagaacggcaatttatttacgacaatccgatctgttttggcgaagagtcgctattttcacgcgttgatgaaattcgagtcctggagaaaaccgccgattccgcccgcattcatgttcgttttacgctgaccaatggcaacaacgaagagcaagaactggttttacagcggcgcgaaggcaagtgggaaatcgctgattttatccgcccgaacagcggcagcctacttaagcagattgaggcaaaaactgccgccagattaaagcaatgagctgaattaaataacaattagccggaacaataaataaaagggaacactatatgaaaacgattttcaccgtgggagctgttgttctggcaacctgcttgctcagtggctgcgtcaatgagcaaaaggtcaatcagctggcgagcaatgtgcaaacattaaatgccaaaatcgcccggcttgagcaggatatgaaagcactacgcccacaaatctatgctgccaaatccgaagctaacagagccaatacgcgtcttgatgctcaggactattttgattgcctgcgctgcttgcgtatgtacgcagaatgataaaaaaatccccggtagcgtgtcagttgccggggatattttttaacgtccaaccgccgctttaggccgtttcttcgcaccagcattcaccggacgagattgcgtagacgacgctttttttgccgtagcaggcgtctgacgctgggtcgccatcggcgtatgtttcgtcaacgccggacgggtattgcggttctggcgacgagcttcacgcatctcttcaatggttggcgcaggcactaagcaatcgcgacggctgccaatcagatgctttttgcccatcgcttccagcgcctggcggattaacggccagtttgccggatcgtggtaacgcaacaacgctttatgcaaacgacgctgtttgtcgcccttcggtacgaagacgtcttcgctcttataaccaatcttcgccagcgggtttttcccggtgtaatacatggtggttgagttcgccagcggcgacggatagaagttctgcacctggtcgaggcggaagcggtgctttttcagccacagcgccagattcaccatatcttcatcacgcgtaccggggtgcgcggagatgaaataggggatcagatactgctctttacctgcctgttttgagtaagtatcgaacagctctttaaagcggtcatagctgcccatgcccggcttcatcatcttcgataacggcccttcttcggtatgttccggggcaatcttcagataaccgccgacgtgatgggtcgccagttctttgatatagcgcggatcttctacggctatgtcataacgcacaccagaggcaatcaggatctttttaatgcctttcagatcacgcgcacggcgatagaggttgatcgttggttcgtggttcgtgtccatgtgcggacaaatatccggataaacgcacgacaaacggcgacaagtttgttcagcgcgtggcgatttgcagcgcaacatatacatgttggcagttggcccaccaagatcggaaatcacgcccgtaaaacctggaacggtgtcgcggatcgcttcgatctcattaatgatcgaatcttcggaacggctctgaataatgcgcccttcgtgctcggtgatagaacagaaagagcagccgccaaagcagccacgcataatgttgaccgaaaaacggatcatttcgtaagccggaatacgggcattgccataggccggatgtggcacgcgcttgtatggcagcgcaaaaacgctgtccatctcttcggtagaaagcggaatagcaggcgggttgatccacacatagcggtcgccgtgtttttgcatcaatgcgcgggcacagcctgggttggtttcgtggtgcagaatacgcgaagcatgggcgtacagcactttatcgcccttcactttctcgaaagaaggcagcaacacgtaggttttttcccacggtttcgggcgcggtggctgcacggttacggctttggcttcctgctttttcggtgccaccggtttgttatccgcgcacggcaaatcttcaccatacggatgcgggattgggtcgatttttccaggggtatcaagacgggtggaatccacgccgctccagccaggcagcgcctctttcacgataatcgcggtattacgcacatcgcggatttcactaattggctcgcccatcgccagacgatgcgccacttccaccagcggacgctcaccgttaccaaacatcagcatgtcggctttcgaatccaccagcacggaacggcgcacggtatcggaccagtaatcataatgcgcggtacggcgcagactagcctcaataccgccgaggatcaccggtacatctttccacgcctctttacaacgctgggtataaaccagtgtggcgcgatccgggcgcttacccgcgacgttatccggcgtgtaggcatcgtcatgacgtaaacggcgatcggcggtataacggttgatcatcgaatccatgttgccagcagtaacaccgaaaaacagattcggtttacccagacgcataaagtcgtctttgctgctccagtccggctgggcgatgatcccgacgcgaaagccctgcgcttccagcatacgaccgcaaatcgccatcccgaagcttgggtgatcgacatacgcgtcgccagtaaccaaaatgatgtcgcagctatcccagccaagttgatccatctcttcacgagacatcggcaaaaacggtgccggtccaaaacaggcggcccagtactgcggccaggagaacaggtcgcgatccggttggatcagggagatagagctcattttgcttccagaaatgataaaaaaataatcaaaggccggggattataagccggaacgaaagagaaatcgaaaggtattccatactcgccctcctcgggcgagtatgaagattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacattacgccttcaatatggaacgcttgcggctcgtccgcgcgtaccgtccagcgttcccacgttccttgctgcgcggtgacatcaatacggttgacgtcccacagctgtccattaatacccgggtcatcacccagactgatatcgcgactgcgaattggcgaaccagccatgatttcagttggcagcaagcgcatcggaagactgtctgtgaccagcggcagaaggccggttgggcgcagcgttagcaccagggtagaaaccagaatactggatggctcaaagaagccacgaatacgatcaacaatgctcgccgcttcgccacaggtgatcgacacttcatcgccgttgctcatatccaccagaatctcgcggcgctcgcccggtgccagcgaaagttgcttcaccgatacaggagcaggcaggaatccctgatcgccagaaatcacatgtaacgggcgaccatcgttcatctgtagttgatagcgacgagagttcgacgcgttcagcagtcgcaagcgcacccagccacgcgagacttcaacgtacgggctttgtacaccgttaaccagcagcgtatcaccaacaaagccgccgcttcccggttcgttgtattctggcgtaccaaagttatccagccgtttatcctggataatgaccggaaaatcatccacaccataatggttggggataggcagcgacttgctgacttcatcttccaccagccacattccggcaaggccgttatagacctgctgagccgtgcggttgggagtattggcgtgataccacagagtagctgcgttctggcgaatgggcagtacgggtgcccagtcagcgtttggcgacatcatccgtgccggaccgcccatcagcgggcctggtacctgtagcccggccaccgtcattgagacattttctgtcaggcggttgctgtaaataagcttaacatcgtcgcccttccagacgcggatagtcggccccaggtaacgaccattgattccccagaccgacgcgcgtgtccctggcgtaaatgaccagtgcgcacgttgtacagtcataaacagcggttgcccacggcgagattcaagtagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccagctcacgaacctgatctttgccatactgactgacgtcaattggcggcagcatttcgacaatcaccagaccgttgtgcagtcgattaagattaatcttattcgaagttgtagagacgcacacgggaataatcgggacgcccgccgcaattgccgcgtgaaatgctccagtcttgaacggtagcaggccgcgaccacggctgcgggttccttccgggaacatccagatggaaatacggcgttttttgaagtgattcactacttccgcaatggtgccgtgagctttagtgcgattgtttctgtcgatcaataagttgccggttaaccagtacaactgcccgaagaaggggatccacagcaagctctttttacctaccgtcaccgtcggcggttgcacgatgttcgatgctgtcaccatgtcatagttgttctggtggttagcgatatagatagcattgccgtagctttcagcgtctgtaggtttacggcactcaactttcaggccaaacagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagtgactttctgtaactcttccgggcgcagtttaattttgcgtttcccaacatgaatggtcagcgtgctttgcggcggcagaacgtacaattgcgccagaccatcttctccacgcgcggcttctgccgatggaatgttgataatcttgttgcctttgcccttcgacagctgcggcagatcacttaccgggaacatcaacatacggcctgcctgagtgattgccagcagcatatcggaagcatcttcaatcaccaccggcggcataacatgggcattttccggtaaggtgatcaaagccttacctgcacggttacgcgccaccagatcgttaaaggtgcagacgaaaccgtaacccgcatcggaagccatcagcagtttctgatcgtcgctttccatcagcatatggtcaacggtcgccccaggcggcaacgttaatttgccggtgagcggctcgccctgaccacgcgccgacggcagcgtaatcgggtcaatggcatagctacgaccggtggaatcaacaaacactaccggttggttgctcttacctttcaccgccgctttgaagctatcacccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgatcgtcaccgtaggcttgcgcgtctgcctgcagttctttcttcagcaggttattcattttacgctcggaagccaaaatgccctgcaactggtcgcgctctttttccagttcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattaaggttaatacgatagctcttttccagatcggtggtagcgaagaggtggttcatcacctgatccatatccacgcggttggaacgcggcacaatcaccaggcgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacggatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcgccccagttcccctgaccatcaaccagcggataacggtaagagaacggttgcgccatcaggaccatcgcttcataacaggcgctatcgccgtgcggatggtatttacccagtacgtcaccgacggtacgggccgattttttaaatttggcgctggcattcaggcccagttcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcaacgtgaatagcgccgccggacgtgctccgacggcgataaaggcatcaatgtgccttgatatacaactctttgctgtagacataatcctggggattatgcagcggaaaaccgccaacgtagggtttaagcagtttgattaacggctgatagtagataggaatcagcggtgcctgttggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaagcatcattgtacgtcgcatcccacgactgccgagacagcatgaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaaggcttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcactcgcacatcgttaaatggcggtttctcaaggttgaagttgtaatattcgctgttcagacgcggaataattcgtagctcgccaggcagtgatttttcaatggcgggaatttgctgcgccggaacccaggtgagatcgacctctcccgcgcgatagcggttatagccggtgaccgaattatctagcgccagatactcaacctgttgcaatactgtatgttgcgcatcgcggtactttggatttttgcgtgcagtaatcttttcgttaactacccactgatcaagcacaaaggcaccgttgtaaaccatgttctctggcttactccagctatcgccatgtttagcgatgacatgatgaggaaccgggaacagcgtcggccaggcgagcatcgtcgtgaaccaaggaaccggctgctcaagcgtaacttcaagagtacgatcatccgtcgctttgacacccagcgatgtaacatctgctttacccgcaacaatagctgcggcattgttaatgtgcgcctgtgccagatagccagcaaaagggcttgccgttttcgggtcaaccgcgcgctgccagccgaggacaaaatcctctgccgtcagaggctgaccgtcggaccactgcaaaccgctacgcagatggaaaatatagcgcttgccgccgtccagtatctcccagcgttcagcctgagcgggctgcacctggccttcaccgtccatccataccagaccttcaaacagatccagcacaatctgcgcggcagtattctcctccaccttttgcgggtcgagcgtacctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccaacaacaatacgcctgtggcattgttcgctcaaacttatcgcgagtgatttggctcacactccggtaaagaaaaaagcgagttgcccccgcttttccattaattaacggatttcattcaatagttctggatgcttatccagaacacgtaaaagtttgattgtggaaggatgaggttgggcattgcctttttcgtaacgcgaaaacgcatttacacctcccccaaaaatttcgcttgcctctttttgggtaagagagagcttttttcgaaccttcactataaattcaggtgccactgtttcggcattcaccgaagcccgaaatgcctttacttgcgccatgaaagcatctgactcttctttattcatgatgctctcttcgcaatggacacaatataaaccgtggatacctttcaatactgtttttcgtccacggaaggtgtatggaatatctttaatgccagaaaccatttctccctggtggcaaaccggacatttcatattacttctccttaaacgagacgatcagtacgtcatgaattaccgtaattttaagataaacctggcctgtaacaagcctgggtctgtaaacatcctgccagatagtatgatcagagtaggtggtcatgcttttataaaagtcgctctctgataatccaatgataacattacacataccatcaaaatccaaacctaactcatctgcatttaacagggcactacgtgttgtacgaacttgcccggcattgacaagttttttaacctgactcaaacgtgtatgtggtgtgcgtttttccataacccccgcctccctgttactttagttataacctaaaaggttaattacagcaatgaaaaagcacctaaaaggttagttagatgtacggagatagtgaccacacaaaacgtattctttaaggaaagtgattgaccatataagaaagtggcgcattagtagcgccagtttgaagcaggaatttataagggaagctggagtcaggcatcacgccaacggcacataaacatccgtttccagtcgctgctctgtcaccccttcggcaagattggtgtagtgaaacagaatcggtgctttacgcattttctcgccgcttgcaggcagccagtggcgaatgatgccccataccgtgtgtgaaatatcgtccagctcgccaacgtggcgggccacggcataacgtccaccggtaagttcaccattgctcacaccataacgattatcgggaatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaattcagggctacagcggtgcggcaacatcgccacaggtattgatgggaaatcgataatgtttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttcaccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgcagggttacccaggtgtcgtcacgcagggattttgcgctttctacagtcgttacgctgccgttcggcccctggaatcctccggcctgactttgcgttgccgatgggccagaaaaaccgccctgctctgctgccatcaccggtgcgctgcacagggccattactgcgattactgctgcgaattttttcatgtttattactccctttaatgtctgtttccgagcatttaacaagatagtccttaacaacttcttaagggaaaaaaataaaatttagtgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgtcgcgcaaactgattgaagagaaactgtatacctgggacgaagaggtcaccagtaatgccgttgaagtgcatgtgcatcatctgcgacgcaaactcggtagtgattttattcgtaccgtgcatggtattggttacacattaggtgagaaatgaaatttacccaacgtcttagtctgcgcgtcaggctgacgctaatctttttaattctggcctcggtgacctggctgctttccagctttgtcgcctggaaacaaacaacggataacgtcgatgaattgttcgacacccaactgatgctgtttgccaagcggttaagtacgctcgatctcaacgaaatcaacgcggcggatcgcatggcacagacgccaaatagattaaaacacggtcatgttgatgacgatgcgctgacctttgccatctttacccacgacggcagaatggtccttaatgatggcgataacggagaagatattccctatagctatcaacgggaaggttttgctgacgggcaactggtcggtgaagacgatccttggcgttttgtctggatgacctcacctgatggcaaatatcgcatcgttgttggccaggaatgggaataccgtgaagacatggcgctggcgattgttgccgggcaattgatcccgtggctggtcgcactgccgattatgttaatcatcatgatggtactactgggtcgtgaactcgcgccgctgaacaaactggcgctggcactacgtatgcgtgaccctgactcggaaaaaccactaaacgcgactggcgtacccagcgaagtgcggccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgcgcagctctctgacgatgatccgcaggcgcggaaaaaagcactgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaaaattgacgtgcgactgacactcaatgcccacagcatcaaacgcaccgggcaaccgctattgctaagtttgttggtgcgaaatttgctggataacgccgtgcgctacagtccacagggcagcgtggtagacgtcacgctgaatgctgataatttcatcgtgagggataacggccccggtgtgacaccagaggcactggcgcgaattggcgaacgcttctatcgcccacccggacaaaccgctaccggcagcgggcttgggctatcgattgtccagcgaatcgccaaattgcatggcatgaatgttgaatttgggaatgcggaacaaggtggatttgaggcgaaggtaagctggtaacttctctgtctatgagagccgttaaaacgactctcatagattttactaatagcaaaatataaaccgtccccaaaaaagccaccaaccacaaaccagacaaataccgagcgagaatacatatacccaaaactcgaacatttcccgcataaagagttttcttaagataagaataataagtggcgtaagaagaaaaaatgctgcaatcattgcttgcaatatacgatcttcgcctgaaacggaaggtatactgcaaatatttcctcccgactcaagcatccagtcatacttattgaaagcaaaaaaagaatctattaaccaataagtaagcattatatatagcaatgcttcaaatattgttttaattttctgctttaacatatatcagtacgctcataaaaatccatttataattatcaacatgacacgttgatactttcatcttttacttattcaaagccatattttcaatccccaaaaaaaccgaaccaaacgtgtaaattattccggtgcgagtaagaattatgaggaatggctatcagtattgtcattttcagaaaatatttatcctgcatcggtgagtcagagtaagatcagacttttgctaaattcgcaaaagactttgcacattttgctaatttcaccgtaccgctctgtgacgtactatagtcggcaaacgtctcaccttgaggttaaaaaatgagcaacatcctgattatcaacggcgcgaaaaaattcgcccactccaatggtcaactgaacgacaccctgaccgaagtcgcggatggcacactgcgcgaccttgggcatgatgtccgcatcgttcgcgccgacagcgactacgatgtcaaagcggaagtacaaaactttctctgggctgatgtggtgatctggcagatgccaggctggtggatgggcgcgccgtggacagtgaaaaaatacattgatgatgtattcaccgaaggtcacgggacgctgtatgccagcgatggtcgtacccgcaaagatccgtcgaaaaaatacggttccggcggcctggtacagggcaaaaaatatatgctttctctgacctggaacgcaccaatggaagccttcaccgaaaaagatcagttcttccacggcgttggcgttgacggtgtgtatctgccgttccataaagcaaaccaattcctcggtatggaaccgctgccgacatttatcgctaatgacgtgataaaaatgcctgatgttccccgctatactgaagaatatcgcaagcatcttgtggaaatttttggttaactagagctcaggctttagaaggagttaaccatgcttaccgtaatcgcagaaatccgtactcgtcctggtcaacatcaccgtcaggcggtattggatcagtttgctaaaatcgttccaaccgtactgaaagaagaaggttgccacggctatgcgccaatggtggattgcgcagctggcgtgagtttccagtctatggcaccggattctatcgtgatgattgagcagtgggaaagcatcgcgcatcttgaagcgcatctgcaaaccccgcacatgaaggcgtatagcgaagccgtaaaaggtgacgtgctggagatgaatatccgtattctgcagccagggatttaatcctgccttgtttgcccggccatcctgaccgggcaatgttctttcctttaaacctcaatctccgccatgtcgcctttctcttgcaaccagttgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttcccccagacctttaaaacgctggacgttcggcttgcctttcttgcgttttaattgctcaagtacgccctctttctcttcttccgtcagcgcgtaataaacctctttcccgagatcaatacggtagagcggtggcagtgcgacgtaaacgtgaccgtgtttcaccaacgcgcggaaatgttttacgaacaaagcgcagagcagcgtggcaatgtgcagaccatcagagtccgcatccgcgaggatacagattttgccataacgaagctggctcagatcgtcgctgtcaggatcgataccgatcgctaccgaaatatcgtgcacttcctgcgaagccagcacttcgtcggaagagacttcccaggtgttaaggatcttacctttcagtggcatgatcgcctgatattcgcgatcgcgcgcctgcttggcagatccgcctgcggagtcaccttccacaaggaacagctcggtacggttaaggtcctgcgcggtacaatcagccagtttgccaggcaacgccgggccgctggtcagctttttacgcaccacttttttggccgcacgcatacggcgctgggcgctggaaatcgccatctccgccagcagttcagccgcctgaacgttctggttcagccacaggataaaggcatctttcaccacgccagaaacgaatgccgcgcattgacgcgaagagagacgctctttcgtctgcccggcaaactgcggatcctgcatttttactgacagcacataggcgcagcgatcccagatatcttccgccgacagctttacaccgcgcggcagaatattgcggtattcacagaactcacgcatcgcgtccaacaggccctgacgcagaccattaacatgggtaccgccctgcatcgttgggataaggttgacgtagctttcggtcagcagttcaccgccttccggcagccacagtagcgcccagtccacagcttcagtatcaccagcgaaattaccgataaacggtttttccggcagcgtcggcagaccatttaccgcttccgccaggtaatcattcagaccgtcctgatagcaccagcgttgttcggtattgttgatctcatctttaaaagtgatctcaacgccagggcacaataccgctttggctttcagcacatgcgtcaggcgtgaaacagaaaatcgcgggctgtcaaagaaggtttcatccggccagaagtgcacactggtaccagtattgcgtttaccgcaagtgccgacaacctgtaaatcctgcaccttttcgccattttcaaaggcgatgttataaacctgaccatcgcggcgcacgttaacttctacgcgcttcgacagggcgttaaccaccgaaatccccacgccatgcaggccgccagagaactggtaatttttgttagagaatttaccgcctgcatgcagacggcaaagaatcagttcaaccgccggtacaccctcttccgggtgaatatccaccggcatcccgcgcccatcgtcaataacttctaacgactggtcagcatgtaaaataacgtccacgcgttttgcgtgacccgccagtgcttcatccacactgttatcaatgacttcttgccccaaatggttagggcgagtggtatcggtatacatccccggacggcggcgaaccggctcaagcccggtgagtacctcaatggcatcagcgttataagtttgcgtcatggtttaagttagtaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttaagatcgtaaatatggcgtgactctagcacatattgctgcccggtgtaggggttctcgttctgaccgagatagtccgtcagcagttcaaacgggcgcaccgccgggtttaccaccactgcgggcagcataaaacattgtgacaaccaggtggcgtaatatccccccagtgacgaaccgacaatacccagcgaatcaccgccatgttccaggacaatggattccagcagctctgccgcgtcggaaggatacggcggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaaacgtgtgtccgccaggcgatgcacctcggtggtcagcgtgccatcagcatgtaactcgagagtacgccagccgggcgcgatggtatccagcgtaaagttggaacagtgcggcttaaactgcacacaggtcgacggcgttgccagcaggcggcgaccattccagtcgagatccagctcctgatgaatatgaccgcacagcaagtatttgacgtgcggaaacttcgccagcacggtatccagttcgcccgcgttacgcagactgtgttgatcgagccaactacaacccgcaggtagcggatgatgatgcagcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcgctgtacatcgcgggctggaaatcgtggttgcccggcagccagacgcagggcgcacgaaaacttgcgatgccttcagcgaaatgctgataggccgcagaggattgatcctgcgctaaatcacctgtcgcgacaatcaggtcgaattcgtgctggtgtggccgaatcgcctccagcaccgcctggtaactctcccaggtgtttacccctaacagggcttcgtgcttttgtgcaaacaggtgagtgtcggtaatttgtaaaatcctgactctggcctcaccagccagaggaagggttaacaggctttccaaatggtgtccttaggtttcacgacgctaataaaccggaatcgccatcgctccatgtgctaaacagtatcgcaaccagtccgctaaaaactgattaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccgtgaataccgcttgcggtcgtggcgtccacttcgcccaccataattgacgaacgctcactggtgccccccgggcttgccaggaaacttaacaccggtttggtccgtttgactatcagtcccgcctcttcaatcgcttcgcgacgggcaacatcttccacactttcaccctcttcaatcatcccggcaaccatctccagtagccaaggggtttcgctggtgtcgtacgcggcaatccgaatctgctcaatcagcacaacttcatcacgcactgggtcaaagggtagcaagactgcggcgtgaccgcgctcaaaaatttcccgccgcacctcatgactcatttgcccgttgaatagacgatgacgaaatctataaagatctaatgaaaaaaagccgcgataaagtgtttctcgtgcaataatttctacatcgtttttgccaaatgtaacgggcaggttgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctttctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccttgcagttaactcaatccatttttgatatgtcgaaatggcgtgcgttaacgctgcaggaaaaagcagcagggattcaggacgtcacgtatcagaccgatcagcaaaccttgatcctcaacaccgcgaccgcttatttcaacgtgttgaatgctattgacgttctttcctatacacaggcacaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggctgcgctgaatgtcgaaaactttaaaaccgacaaaccacagccggttaacgcgctgctgaaagaagccgaaaaacgcaacctgtcgctgttacaggcacgcttgagccaggacctggcgcgcgagcaaattcgccaggcgcaggatggtcacttaccgactctggatttaacggcttctaccgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcacagtacaactttgtcggtgccagcgagcaactggaaagtgcccatcgtagcgtcgtgcagaccgtgcgttcctccttcaacaacattaatgcatctatcagtagcattaacgcctacaaacaagccgtagtttccgctcaaagctcattagacgcgatggaagcgggctactcggtcggtacgcgtaccattgttgatgtgttggatgcgaccaccacgttgtacaacgccaagcaagagctggcgaatgcgcgttataactacctgattaatcagctgaatattaagtcagctctgggtacgttgaacgagcaggatctgctggcactgaacaatgcgctgagcaaaccggtttccactaatccggaaaacgttgcaccgcaaacgccggaacagaatgctattgctgatggttatgcgcctgatagcccggcaccagtcgttcagcaaacatccgcacgcactaccaccagtaacggtcataaccctttccgtaactgatgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggctggcatggcaccagaaaaccaggcgcaggcccagcaatccagcgggagtttctggatgccgctgatggccggttacatgatggggcgtctgatgggcggcggcgcgggatttgcacagcagccgctgttctcctcgaaaaacccagccagtccggcttacggtaaatataccgacgcgacgggtaaaaactatggcgcagcccagccaggccgcaccatgaccgtaccgaagacggcaatggcaccaaaaccggcgaccaccactaccgttacccgtggcggttttggtgaatctgttgccaaacaaagcactatgcagcgtagtgcaaccggtacctcttctcgttcaatgggtggctgataccgatggaaagagtcagtattaccgagcgcccggactggcgtgagaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggtgaacctaaacttctggaaaataacgccgatacgccaacgtcactatacgaggcggcgttctttcagtggatctggctggaagatcagcttaacgccggtaacttgccggagggcagcgaccagtttaacagtctgcaagaaaaactgatcgatcgcttcgttgagctgcgtgaacagtatggcttccagttgctgcatctcacctgctgtcgcgacacggtggaagatcgcggaaccattcagtatttgcaggactgcgcaacggaagctgaaattgctactgagttcctctacatcgatgatatcgggttaggtgaaaaaggtcagttcacggatttacaggatcaggtaatttccaacctgttcaaactgtatccgtgggaatttatgttgcgtgagatgttctcaaccaagctggaggatgcaggcgtacgctggctggaaccggcgtggaagagcattatctccaacaaggcacttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgaagcagcggaaggtccgtatggcgaagaagggatgattgttcagcaattccacccgttaccgaaattcggcgacagctatatgctgattggtagctggctggtgaacgatcaacccgccggaattggcattcgtgaagaccgtgcattgatcacccaggatatgtctcggttttatccacatatttttgttgaataagccacgataccggatggcactcgccatccggtaattgttagcctatctgcaccgacagcatactcaggctgcccatttctataccctcaaccggaatggtaattggctcctgcccatcccacgcacctaacacatacaacaacggcaaataatgctctggcgttgggttcgataacgtgccaccttcatggtcgaggtaattcaccagaggatgttgttccactggcccttgccacgtcagattcgctttcacatactcattaaacgacgtcgcccacggatacggtgaactatcaccgtgccacttcactgtgcgcaggttatgcaccacgttaccgctggcgaccaacattattccttcatctcgcagcgctgccagtttgcgccccatttcgaaatgccaggcggcaggtttgctactgtcgatactcaactgcaccatcgggatatcagcgtcaggatacatcttaatcagcacgccccacgagccgtggtcaaagccccaggcttctttatccagcgtcaccgggatcggcgctaacagctcaaccagacgctgtgccagcgcaggcgaacccggagcaggataatgcgtatcgtacagcgcctgcgggaagccaccaaagtcatgaatcgtgggcggcgtctccatcgcggtcactcctgttccacgggtaaaccagtgagccgaaaccaccacaatcgcttgcgggcgtggcaatgtcatccccaacttctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtgaagatttataaggagttgtcgatgtcagtacctctcattctgaccatactggcgggggcagccacgtttattggcgcgtttctcggcgttctcgggcaaaaaccctcgaaccgcttactggcgttttcgctaggttttgcggcggggatcatgttgctcatctcattaatggaaatgcttcctgccgcactagcagctgaaggaatgtcgcctgtgttgggttatggaatgtttatcttcggtctgcttggctattttggcctggaccgcatgttgccacatgctcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgcactggccgtcgcgttgcacaatatccctgaaggtctggcagtggcaggcccggtttatgcggcaacggggtctaaacgcaccgcgattctgtgggcggggatttctggactagcagaaattcttggtggtgtgctggcgtggttaatcctcggtagcatgatttccccggtggtcatggcggcaatcatggcggcggttgcaggaattatggtggcgctctcggttgatgaattaatgccgctcgccaaagagattgaccctaataataaccccagctatggcgtactatgtggaatgtcagtgatgggattcagtttagtgctgctacaaacggcgggaattggttaaaaacaacatcagaagttgtccagcgcatggacaacttctgccagcttcacgaaagccttattctaccttttcggctgtctcttctctcgtactgtttaagtatttgttccgcgcttcaagcagtgcgtctctgtcctggcgaaacgcccgacaataacgtttcaaatgcaggaaataacccaccacaaccagagcaatcaatacaatccagtaccaggcgataaacatccttttacccttaatatttaacaatactaaacatttagcgtataaatttcacatatcctttttcggatatattcatatggtcgcataataacggaacaattatatgattttgatcataatgaaaaagaatgcctgatattaatgaaattttctcatagaaagagaagcggaattaacatcttgcatagcagggaaaaataaaaaccgaagcctgctacaacttcggtttcttgattaaggcagtaaattaagcagcggttttcagctggctttacgctcatgtgcctgacggtatgccaccaggtcttcaatagtcacgagcgccatattgtgtttattggcaaactcaatacactctggtgcacgcgccatcgtgccatcgtcattagtcagctcacacagtacaccagccggtttaaagcctgccagcgtcatcagatcaatagttgcttcagtatgaccgccacgcgtcagtacaccacctgcctgagcgcgaagtgggaaaacgtggccaggacgattcagatctgacggttttgcgccatcggcaatcgctgcgcgaacggtcgtaatacggtcagcggcagaaacaccggtagtcacaccttcagctgcttcaatggtcacggtaaaaccggtgccataggcgctggtgttattttctaccatcattggcagatcgagttgtttacggcgatcttcagtaatgcacaggcaaacaataccgctaccgtggcgaatggtcagcgccatctgctcaacagtcatggtttctgccgggaagatcatatcaccttcgttttcacggtcttcatcatcaagcaccattacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcacccaaagcgctcgcgggctttcaactgagttgatttaccgccggtggggaatttcgccccgccctgagaataagcggattcactataacgctaatgattagcggcagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgcctcgaccttgtaagccgtgaagagttcgacgtccaaacgcaagtcctgttacggactcgtgaaaaactggcgctgcttgaacaaagaatcagcgaactggaaaatcgcagtactgagatcaaaaagcagccagatccagagactctccccccaacgctgtaaacattcgtctttaatgcactgtaaattatgaattaatcctctaatttatagtgctttctattaccttatcgcgtaatcccattcagaaaaccatcacaaaaatgaatgagtacaattgaaagtataattgcaatgtattttttaagttttacttaatcgatatttagataaactaattttataaaaaacacaaaataaaatatcatatttcaatgattagtagtccttaaataacagttactaatcattctcttttctacttatctttatataaaggaatattatgtccgcttttaaaaagtcacttcttgttgctggcgtagcaatgattctttccaataacgtgtttgctgatgaaggtcacggtattgttaaatttaaaggtgaagttatctctgctccatgttctattaaaccaggtgacgaagatttaactgtaaatctgggtgaagtagcagataccgtactgaaaagcgatcagaaatctttggctgaacctttcactattcacctgcaggactgcatgctgagtcagggtggaactacttattcaaaagcgaaggttactttcactacagcaaataccatgacgggtcagtctgatcttctgaaaaataccaaagaaactgaaatcggcggcgccactggcgttggcgtacgtattctggacagccagagcggcgaagtaactttaggtactccggtagtaattacgttcaacaataccaacagctatcaggaactgaatttcaaagctcgtatggaatccccaagcaaagatgccaccccgggcaacgtttacgctcaggctgactacaagattgcttacgagtaatcgcatttggccgggttcgcccggccacatcattaacggattaatgataagtggatcagatgtataaaaaattaaaattaaccacaataagcgaattgattaaaaatatttattgttcattatccgttattagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccagttatcatcattggttgtgcgtcagcttatgccgttgaattcaacaaagatttaatcgaagccgaagatcgtgaaaacgttaacctttcccaatttgaaactgatggccaattacccgtcggcaaatattcactaagcactctgattaataataagaggacgccaatccaccttgacctccaatgggtattaattgataaccaaactgcagtttgcgtgacaccagagcaattaacattattaggatttactgatgaatttattgaaaaaactcagcaaaacctgatcgatggttgttaccctatcgaaaaagaaaaacaaattacaacttatctcgataaagggaaaatgcaattatccatatctgcacctcaggcatggttaaaatacaaagatgcaaactggacgcctcctgaactttggaatcatggtattgctggggcatttcttgactacaatttatatgcctctcattatgcaccacatcagggcgataattcgcaaaatataagttcctatgggcaggctggggttaatcttggggcctggcgcctgcgtactgattaccagtacgatcagtcatttaacaatggcaaaagccaggcgaccaacctggattttccgcgtatttatttgtttcgcccaatcccagcaatgaatgcaaaactaactataggtcaatacgatactgaatcctctattttcgactctttccatttttctggcatttcgttgaaaagcgatgagaatatgttaccgccagacctacgtggttacgcaccgcaaatcacgggtgtcgcacaaacgaatgcaaaggtcactgtctcacagaacaaccgtattatttatcaagaaaatgttcctccaggcccatttgctattaccaatttattcaatacattacaggggcaacttgacgtcaaggttgaagaagaggacggacgcgttacgcaatggcaagttgcatctaatagtattccttatctgacgcgtaaagggcagattcgctacaccactgctatgggtaaaccgaccagcgttggtggtgattccttacaacaacccttcttctggactggtgaattctcatggggttggctgaacaatgtatccctgtatggtggttcagttttaacaaaccgtgattatcaatctctggctgccggcgttggttttaatcttaactcattaggttcattatcttttgatgtcacacgatctgatgctcagttgcataatcaggataaagaaacgggttatagctaccgcgctaactattcaaaacgttttgaatctaccggtagccagctcactttcgctggttaccgtttctctgataaaaactttgtgacaatgaatgaatatatcaatgacactaaccattacacgaattatcagaatgaaaaagagagttatattgtcacgtttaaccagtatcttgaatcattaaggttaaatacatacgtaagtttggctcgtaatacttactgggacgccagcagtaatgtgaattattcattatcacttagccgcgattttgatatcgggccattaaaaaacgtctccacttctctaacatttagccgaataaactgggaagaagacaaccaggatcaactgtacctaaatatttcgattccctggggaactagtagaacattgagctatggtatgcaacgaaatcaggataatgagatttcgcatactgcttcgtggtatgactcttccgatcgaaataattcctggagcgtttctgcttcaggcgacaatgatgaattcaaagatatgaaagcgtcactacgcgccagttatcagcataataccgagaacggtcgactctacctctccggtacatcacagcgagacagttattattctctgaatgccagttggaatggttcattcactgcgactcgccacggtgccgctttccacgactatagcggtagtgctgactcgcgttttatgatcgacgcagacggcactgaagatattccgttgaacaataaacgcgcggtaactaatcggtatggcatcggagttattccatcagtcagcagttacataacaacatcattaagtgttgatacccgaaatctgccagaaaatgtggatatcgaaaactcggttatcaccaccaccttaaccgagggtgctattggctacgccaaacttgatacccgcaagggctaccaaatcataggggttattcgcctggcagatggtagtcatccaccactggggattagcgtaaaagatgaaaccagccacaaagaattaggactggttgctgatggcggctttgtatacctcaacggcattcaggatgataacaaacttgctttacgctggggtgacaaatcttgttttattcaaccacccaatagcagcaacttaaccaccggaacggctattttaccgtgtattagccaaaattaattcaggatgaaactaatgcgctacttaaatacaaagaatatcattgcagcaggagtattactctcctgtatgagcagcattgcctggggtgccatcatcccggatcgtacccgtatcataatgaatgagtcagataaaggcgaagcattaaaacttactaatcaaagtaaaaacctgccctatctggcccaaacatggatagaagatacgaaaggcaataaatcgcgtgactttattgtcactgttcctccaatggtgcgtttaaatcccagtgagcaaattcaaataagaatgataactcaggaaaaaattgctcaacttcctaaagacagagaaacgctcttctattttaacgtgcgagaaataccgcccaaaacagataaaaaaaatgtgatgcaagtcactatgcagcacgcattgaaactattctggcggccaaaagccattgaattagaagacgatggggtaatgacttacgaaaaagttgaaatcattcgtagaaatgacggttcgatccgctttaacaataagatgccttatcacgttacgctgggttatatcggaacaaatggggtaacgatgttaccacaaacgcaaagcttaatggtaaccccttttagctatgcaaatacgcagtttaaaaatgttccgtcaacttttcaggtgggttatatcaatgactttggtggattaagtttttatgaaataaactgccctgtagtaaataacatttgtaatatttctgtagccaaccgagatcaataatatgcgctacttgttaattgttattactttttttatgggttttagttcattacctgcatgggcaatggactgctatgctgaacatgaaggtggaaataccgttgtcattggttacgtaccaagaatctctatccccagcgatggtaaaaaaggtgataaaatctggcaaagcagtgaatattttatgaatgttttctgtaataatgcactaccaggcccatctccaggagaagaatacccatctgcatgggcaaatataatgatgttgttagcatcaggtcaagacttttataatcaaaactcttatactttcggtgtaacttataatggggttgattatgattctacatctccactacctattgcagcacctgtatgtattgatataaagggagccggaaccttcgggaatggctacaaaaagcccgcagtctgtagtggcggtcctgaaccgcaattatcagtaacttttccagtacgagtgcagctatatattaagctagctaaaaatgccaataaagtaaataaaaaacttgtattacctgacgaatatatagcacttgaatttaaaggtatgagcggagcaggtgctatagaagtagataaaaatctgaccttcaggattcgcggattaaataacattcatgtccttgactgctttgttaatgttgatctggaaccagctgatggcgttgtcgactttggtaaaataaattcccgaacaattaaaaataccagcgtgagtgagacgtttagcgtagtcatgaccaaagatccgggtgcggcctgtactgagcagtttaatattttagggagttttttcactacggatattttgagtgattatagccatctggatataggtaatggtctgctattgaagatatttcataacgatggaacagcaacggaatttaaccgcttctcacaatttgcttctttttcatcgtctagtgcgccttcggtcaccgcaccattcagggcagaactgagtgcgaacccggcagaaacggttgttgagggaccgtttagtaaagacgtaatcctgaaaatcacctataactagtatctaatacaaacactaaaacgggccatcaggcccgttatatcagtgctctaactccagctctcttgcctgcatcatctgttgacaataccaggcataacgtgcgcaaaaccaggttctatgttcttcatccatgttaccagtaacggccagaatatcgaccgggcgaccttctgcgtgcattctggcaaaactacgcgccaggaaatcgaaattatttaaagaattaagactatgatccataagcacatcctccggttatcgcataccttttaaggccatatgctttttctgatttcagtattccccaatcagtgtagtgcctttaaacataacgtgcgtaaatatattgtccccgatcacactttttagtgaaaaataaaaaaccatattaaaagactttctcttccagaacttctctaacctgtgttattattaacacagataaatgtaagcaaggaaactattacaaagtaaatattgcgtcactaaatggacattggagtgatatatgattttattcgccgactataacaccccttatcttttcgctatttcctttgtactgttgatcggcctgttagaaatttttgcgcttatctgcggtcacatgctctccggtgctcttgatgcacatcttgaccattatgattctataaccacaggtcatattagccaggcacttcattatctcaatattggaagattgccagctctcgtcgttctctgcttactggctggtttttttggtcttattggcatcctgttgcagcatgcctgcatcatggtctggcaatcaccactgtcgaacctgttcgtggttcctgtcagtttactgtttacgattattgcggtgcattataccggtaaaatagttgcgccctggattccacgcgaccatagttcagctattacagaagaagaatatattggtagcatggcgttaattaccggtcatcaagccacttcaggtaatccctgcgaaggaaaactcaccgatcaatttggccaaatacattatttactactggagcctgaagaaggaaaaattttcactaaaggagacaaagtgttaattatttgccgactttctgcaacgcgatatttggcggaaaataatccctggccccaaatattgtaatttattaatcaaaaggaaatttaataatggatgatattgttaattctgtgccctcctggatgtttaccgcaattattgccgtatgcattctgtttattattggaattattttcgccaggctctatcgtcgcgcttcggcagagcaagcttttgttcgtactggtttaggtgggcaaaaagtggtaatgagcggtggcgcaatcgtgatgccgatctttcatgaaataatccccatcaatatgaatactctgaagctggaagtcagccgctcaaccattgatagcctgattacgaaagatcgtatgcgcgtcgatgtagtagtcgctttctttgtgcgggtaaaaccttcagtagaagggattgccaccgctgcccagacgctggggcaacgcaccctgtcgcctgaagacttacgtatgttggttgaagataaatttgtcgatgccctccgtgcaacagctgcgcaaatgaccatgcatgagttacaggatacccgcgagaactttgtgcagggggtgcaaaatacagtggcagaagacctgtcgaaaaacggtctggaactggagagcgtttcacttaccaactttaaccagacctcgaaagaacatttcaatccgaacaatgcctttgacgccgaaggtttaaccaaactgactcaggaaacagagcgccgtcgccgcgaacgtaacgaagttgaacaggatgtagaagttgcggtgcgtgaaaaaaatcgcgatgcgctatcgcgcaagctggagattgaacagcaagaagcgtttatgacgcttgagcaggagcagcaggttaaaacccgtactgccgaacagaatgcacgtattgcggcttttgaagctgaacgtcgtcgtgaagcagagcagacacgaattctggctgaacgacagattcaggaaacagaaatcgaccgcgaacaggccgtccgctcaagaaaggttgaagctgaacgtgaagttcgcattaaagagatcgaacagcagcaggtcaccgaaatcgctaaccagacgaaatcgatcgctattgccgccaaatcggaacaacagtcccaggcagaagcgcgtgctaatctcgcacttgcagaagcggtaagcgcccaacaaaacgtagaaaccactcgccagactgccgaagccgatcgtgctaaacaagttgccctaatcgctgccgcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggccttgttgcaggcgctgcctgcggtaatagagaaatccgttgagccgatgaagtcaatcgacggtatcaagattattcaggtcgatggtctgaatcgtggcggcgctgcgggtgatgcaaacacgggtaatgtggggggcggaaacctggcggaacaagcattatcagccgctctctcttaccgcacacaggcaccgctgattgactccttgctcaatgaaattggcgtttcaggcggctcactggcggcattgacttcacccttaacctcaacaactcccgtcgaagaaaaagcagagtaaaccctcttccaggaataatccctggcccaaaaagccggggattttttatatctgcgttccgctaaaaagtgcaaatgatcaggttgttgcagcattttgcgtgacggctcggggaaggcaaaactgcatcagagaaagcattgcgtggggtctggcgctcatcaacaatcggggagtcagcagggggctgaaacgggaaagcccctcccgaagaagggggccttacagaaggaaagggttatgatgaagctcgtcatcatactgattgtgttgttactcgtaagtttcgcagcttattaacagccaatcagaggggggagaaatcctccctcacccttgttcctttactttaggttgaaaaaaaatcagcgtcaagaaggtttcattaacacatatccctggcccaaaaagccggggattttttatatctgcgttccgctaaaaggtgcaaatgctcaggacgttgcagcgttttgcgtgaccgctcggggaaggcaaaattgcctctgggaaagcattgcgcggggtccggcgctcatcaacaatcggggggcagcaaggggctgaaacgggaaagcccctcccgaagaaggggccttgtataaggaaagggttatgatgaagctcgtcatcatactggttgtgttgttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttggatcttcttgatgatgttggtcgtcgagcaaccgtcttcaaagttgagcaccaacacttcgccaccgttggcccagacttctttactcccggcaatctcttctggtttatagtcgccgcctttcaccagcagatctggcaagatcccggcgatcaagcgctgcggcgtgtcctcttcaaacgacactacccagtcgaccgcttccagtgcgcccagcacaatcatacgctgttcgagtgggtttaccgggcgggaatcccctttcagccgtttggtggaggcatcgctgttgacggcaacaatcaagcggtcacccagcttgcgggcatttgccagataagagacgtgcccggcgtgcaggatgtcaaagacaccgttggtcatcaccactttttcaccacgtttacgcgctgccgctacggccagcttcagttcctcttcggtcatcacgccaaagcctgtatctgcacgtccacgtacagcattttccagctcgatcggcgaaaccgtggaggttcccagtttgccgaccaccacgccagccgccgcattggcaaagaagcaggcttcttccagcgaattacccgctgccagcgttgccgccaggacgccaatcaccgtgtcgcccgcaccggtaacgtcatacacttcctgcgcttgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtaccttttggatcaatcagcaccggaacacccgctttacgcgccagttggatcatctgctgtacgcttgccagcgcacctttggcgtagtcagaaagcaccagcgcgccaatcgaactcagcgcctgattaatccgctcgtgcagcggctgcggatcaacaccttcgaaaccttcttcaaaatccagacggatcagctgttggttgcgggaaagtacccgtaatttggtaatggtcggatgcgtcggtacagaaacgaagtcgcatttgacgttgacgtcggccagagatttactcagcgcgcgcgctgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacgactggtggggccgtaccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgaagcgtagtgtaagcacgggtcagcgccatcgcttcctgctcttccataatgtcgttttgcgccagtagttccagaatacgcacgttgtctgaccagcgcgttaacttcggtttttcatgagcgtagcgcaacaccagatattgggtaataaattcgatatcggtaattcccccttcatcagctttgatatcaaagcgatcgcgatgtttattgccgagatgagcgcgcattttctcgcgcatttcccgcacttccgtttgcagagttttaccttcacgcggcagcgtcataatctcgcgacgcactgcgtcaaagtgcgcggtgagctgcggatcgccgtacactacacgcgcacgcaccagcgcctgatgttcccacgtccaggcctcgtttttctgataatcggcaaatgcttctgcggatgtcaccagcattcccgccgccccggacggacgcagtcgagcatccacttcatacaaaatgccggaagaggtacgcgtactgaacagatgcataatgcgttgcgccagacgcagataaaactgccgcccgtcgatttcccgctcaccgtcagtcatcgcatccattgggcaatcatggaggaagataaggtcaagatcggaactgtagcctaactcccagccgcccagcttgccgtagccgaccaccgcaaaaccacgcccttcgcgttcgttcaggtgattcggcttaccgtagcgggcaaccatttgaacccacgcctgctgaacgacggcatctatcatggcttccgccagccaggttaagtgatcgctcactttcatcaccggtagcgtaccggcgatatccgctgcggcgatgcgtaacagctgcgcctgtttgaactgacgcagcgcctcaagctgttgctcttcgtcatcttccggcacgcgcagcaaatactggcgcaactcatcgcggtaggcatcggtcgccgtcggctggtaaagggtgtttggatcgagcaattcatccagcaataatggataacgcgccagctggctggcaatcatcggcgacgcggcacacagagaaatcaaatgtttaagcgccgcggggaattcactgagcaattctaaataggtggtgcgggtaacaatccccaccagcaaggcggtaatgcgcgacagcgtaacggcagcgtcttcacgcgcacagacatcacttagcagatgcggcatcagatggtcgagcacctgacgtcctcgcggcccgatggtgcgcttatccagctctttgcggaaatcggcaatcagcgttagcacctgtttgcgatcatcctcgctaagatgcgccagcactggcgtagtgtcatcttcctgcaacgcatcctgccacagctcacgccactgttccgacagcgactcttcctgagtttcactttcatcgtcgccaatcaattcattaaacacccggcgcacattggtcatatgtgcggtcagcgccccggtcagttgcggccagtcagcaaagtccatcgcccacgccagccgcgcacgattaagctcatcagaaggaagcgtctgggtttgttcgtcgttaatgctttgcagcaggttttccagacgccgcaggaacagatacgccactcgcaattgttcagcatcgttttcagaaagcagatgcagctcggcaatggcgctgagcgttggcagtaaagagcgcgattgcagcgacggttcgcgtccgccgcgaatgagctggaacacctgaacgataaattcaatttcgcgaatgccgcctgcgccgagtttgatattgtcggtcaaaccacgtcgacgcacttcacgggcaatcatccctttcatgttgcgcagcgactgaatcacgctgaaatcgatgtaacgacggaaaacaaacgggcgcagcatcgcacgcaactcgttagcatagacgccttcgctatcgcccataatccgcgccttgaccatcgcgtaacgctcccagtcgcgcccctgctcctggtaataatcttccaacgcggcaaagctcagcaccagcgggccactttcgccaaacggacgcagccgcatatccacgcgatagacgaagccatcctgcgttggttgatccagcactttaatcagccgctgccccatgcgggtaaaaaactgcgcgttatccagttcccggcgtccaccctgcgtacaaccatgttccggccaggcaaaaatcagatcgatatcagaggagaaattcagctccccaccgcccagcttacccatgcctaaaatcagcagcggttgcgcttcgccctgcgcattgcacggcgttccccactcgcggcagcaggcgtcatacagccagtcacgcgccgcaacaatcagcgtctccgccagatagctgagctgctgcaatatgctctcttcagtaaccagtgccagcgtttgcgcccaggcgatgcgcaccataatgcgccgccggaatagccgcagctcgcgcattaacccggcttcgtcactcacattacagagcgcctcctgcaaccatgccgcgtaatgctgccattcgtcggcctgcggcggttggctttccagttccgtcagccactctggatgcgcaatcacgctgtcctgcacaaaatcactaaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcgatgcgttgcccggtcgcaatagcgtgatgcagcccctgccagttctccagccaggcttgcgcgacgacaggatcatagtaacccgccagcaacagtattgagtcaatatcacgcgtcaggcgtggcaactggtcacggtagcgatcgcctaacggctggcagaaaacgcttttcagttcagcggcatggcgggaaagatggatatcggcaaagcgtttgaaggagtcgctgattttgccctgcgctttggcatctaaaaatggctgccatgctttgcttaccaaccattcggtcaacgccagcttcgccattgccgtttcggtagagtagaccgccgtcacggcagacaccgcagaagcaatggtcgcctcgcattgagtcagcagatcacgtaagtgagtgctcgctttacgcggcacaataccaccgaacagcatcagcgtatgacggaccaggctaatggctgccagcacctgttctttcgccgcatcgttgccgcgtacccacagttcttcatgatactgccattgcgctaacgccagctcgagcgccgcttccagcccctgttccacatcggcttttgccgcaacatgcaaaatggtggtcggtttgatttcacgcgccggattgccctgcgccagatgatagccacgcgccgctttgctcaggctgccctggcgtaatccggtttgcgataccagttggttcgccagtttcagcaccgcgcgcgtgtcgccgctaagcagttccagttccagctcacagataggttcagcaaattcacccgctttcacttccccctggtcgagggcgatttcaatttggctaccatcgaccgccaccagccatttttcgcgataaaaatcggtgctgaacagcggctgcacgcgggaggcgagatcggcgggcaattcgccgttcggccagacttccgtcggtaactgcgccaggtcgagcgtcggttcgctcaacgccacgttatattccgggcgctgatgtaagccgcctgtcactcttcctgcaactttcatggtcatctcatagcgaccgttttcgccacgaatacgtaagcccatatcgtgcccacgcagccagttatccggcgtttcgtagtaaatattcagcaactgcacggggtcatggtgctcgccgcccagcgtattgagatggtcacgcaacgcctcaacggcactgtgattaacaataaactttaattcgatttcctgagccatggcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgcgactgccgtctcacacgctgaagaaacgcgctatgtttccgacgaactgaatacctgggtccgcagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcaatggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcgctggcacgtaccgaacggaaatccggttccggttacaccggttttacttgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtattgcgcgtggcgcgttttgctgcgcgttatgcccacctcggttttcgtattgccgatgaaactctggcgttgatgcgcgagatgacccatgcgggtgaactggaacacctgacgcctgaacgggtatggaaagagacggaaagcgccctcaccacccgcaatccacaggtgttcttccaggtactgcgcgattgcggcgcactgcgcgttttattcccggaaattgacgcactgtttggcgttccggcccctgccaagtggcatccggaaatcgatacgggtattcataccttaatgacgctctcaatggcggcgatgctgagtccgcaggtcgatgtccgtttcgcaactttatgccacgatctcggtaaagggctgacgccgccagaactctggccgcgtcatcatggtcatggcccggcgggtgttaagttagtggaacaactatgccagcgtctgcgcgtgccaaatgaaattcgcgatttagccagactggtggctgagtttcacgatctcatccacaccttcccaatgctgaacccaaaaaccatcgtcaaattatttgattccatcgatgcctggcgtaaaccgcagcgtgtcgagcaactggcgctgaccagcgaggctgacgtgcgcggcagaaccggttttgaatcagcggactacccgcaaggccgctggttgcgcgaagcctgggaagtggcgcagtcagtgccgacaaaagccgtcgttgaagcgggatttaaaggtgtggagattcgcgaggagctgacccgacggcggattgcggcggtagccagctggaaggaacaacgttgcccaaagcctgaatgagtattgggcattttgccggatgcggcgtaaacgccttatccggctacatgtcaacgacagttgtaggcctgataagacgcgcaagcgtcgcatcaggcgttgattgccggatgcggcgtgaacgccttattcggcctacgcaatcgttgacaacgccaagcatccgacactattcctcaattaaaagaacacgacatacaccgcagccgccacaataaagcgataaatggcgaacgggataaacgaaatgcgcttaatcaattgcaggaaggttttaatcgctatcagcgccaccacaaaagcggtgataaacccaacggcaaacatcgggatatcgccgcttgtcaggaagccccagcttttgtagagatcgagcgccgttgcgcccatcatcatcggcaccgccagcaggaacgaaaactcggaagcagcgtaacggctcacccccatcagcatcccacctgaaatggtcgccccggaacgggagaaacccggccacagcgccagacactggaaacagccaatcataaatgcctgacgataggtcatatcatcaagacccggcgcacgcggctctttcggcttcaggcattcggcggcaatcagcaacaaaccgccaacgaccagcgcatacatcacatttatcgggttaaacaatgacttaatcgtgtcgtggaacaacagccccaataccaccgccggaatcatccccagcaaaatgtggatcagcgttaaacgacctttgctttcaccttcgtgctgcaacgggcggccaaagtggatgccaatcaggccaaacagacgccgccagaacatcactactaccgccagaattgatcctaactggatcacaacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattattaaaatgtaccgcttgtccgaactactgcgtatgaccaggttataaccgtttggtttaacagctgtaaaattaattattttctttcagattattgccacgctcaatgattacgccaacattcgccgcccgcgccactgcgcctggcttgctgagtttgatacgcacccacggcgagttgaagcgtgctaacagcagctccgccacctcttcagccacgcgttccaccagcgcaaaacgcgccccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatagtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggctgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggatttaaaggaggaaaaggcgttgctaccgcttttggtgccatcgcacccattggctgggatctcaccggagtaatggcgggaacctggttactgaccgtgctattgagcggatactcgtcgctgggagcgattgtcagtgcactgattgctccgttttatgtctggtggtttaagccacaattcaccttcccggtttcgatgctctcttgcctgatcctgctgcgtcatcatgacaacatccaacgtctgtggcgtcgtcaggagacaaaaatctggacgaaattcaaaagaaagcgcgaaaaggatcccgagtgatttctggtggatctacatgacctgatagccttcatcgggcttgcccagccgttgctggcaccatgccgccagaaattccacgcagacacgtaatttcatgctgcgatagagcggctcccggtaaacagcccagatattggcgctttgtgcatactctggcaatacttgcaccagtttgccactctccagaaacggcaacacatcccactcggaacgcagcataatccctttgccctccagcgcccattgcagcacaatctcgccgctattggaggaaagatgcccgcttaccttcaccgattttttctcctgaccgttccccaactcccatattccatgggtcatatcgcgctctttggtcaccagacagtcatgacgacttaattcctgtagggattgtggctgcggatatttttgcagatactcaggtgctgcgcataatattcttttattttttgtcaaaagatgcgcaatataataatcaggaatttcgtcattaatacgaatatccagatcaatattatcctgcactaaatcaatttgccgatcgaacaattcaaaatgcacctgtaactcaggataattgcgcatcagttcggtaatagctggcgcaatatggctgcgcccaaaaccaaaactgcaaccaatacgaatcatcccctccgggcgcgttttgatttgcgtgacgtcatcgaccagtcgctgatattgggtgaggatttccaacgcatgttcgtaacaacgttggccactttcagtcagcgccacgccgcgagcggagcggttcagcagcgttgttgccagcgtattttcaaggatttggatccgcttggtgacaaatgcaggcgtctgcccaagcgtcgccgctgcggcgctaaaactcccgctgtgaacgatttctaccagtacctgcaagtctttggctaaaggccagctattcagcatcgttaattatccgcagttgtgataagcgcagtgtatttcgcaaaacattgccattccctgctctggcgcaatattcattcttattttcgcgttgattcacgaactgttaattacatattcacggtggcaaaaaatataaaaccacatttttagtggtagtttgtggcggtgaatttttccagacaaatacaaaaactggagttgccatgatgagcgaaagtaataagcaacaggcagtgaataagttgacagagattgtcgctaactttaccgccatgatttctacccgaatgcctgatgacgtggtggataaactaaaacagctaaaggatgccgaaacgtcgtcgatggggaaaattatctaccatacgatgttcgacaacatgcaaaaagcgattgacctgaatcgtcctgcctgtcaggacaccggggagattatgttcttcgttaaagtcggttcccgcttcccactgcttggcgagctgcaaagcatactcaaacaagccgtggaagaggcaaccgtcaaagcgccactacgtcacaatgcggtagaaatttttgacgaagtaaacaccggcaaaaataccggtagcggcgtaccgtgggtcacctgggacatcatccccgacaatgacgatgcggaaatcgaagtttacatggcaggcggcggctgcacgctacctggccgctcgaaagtgttaatgccgtcagaaggctacgaaggcgtggtgaaattcgtcttcgaaaatatctccaccctcgccgtaaacgcctgtccaccggtactggtgggcgtgggcatcgccacctcggtggaaaccgccgccgtactctcgcgtaaagccattttgcgcccgattggcagccgccatcccaatccaaaagcggcagaactggagctacgcctggaagaaggactcaaccgtctggggattggtccacaagggctgaccggcaacagttcagtgatgggcgtacatatcgaatctgccgcccgccatccgtcaaccatcggcgttgctgtctctaccggctgctgggcgcatcgtcgcggcacgctgctggttcatgccgatctcacctttgaaaatctgtctcacacccggagcgcgttatgaaaaagatcctgacaaccccgatcaaagctgaagatctgcaagatattcgcgtcggcgatgtgatctacctgaccggtacgctggtgacctgccgcgacgtttgtcaccgccgtttgatcgaactgaaacgtccgatcccttacgatctcaacggcaaagcgattttccacgctggccccatcgtgcgcaaaaacggcgacaaatgggagatggtctccgtcggcccgacaaccagtatgcgtatggaaagttttgaacgtgaatttattgagcagaccggcgtgaaactggtggttggcaaaggtggtatggggccgctgaccgaagaaggctgccagaaattcaaggcgctacatgtgattttcccggcaggctgcgcggtgctggcggcaacccaggtggaagagattgaagaagtgcactggacagagctcggaatgccggagtcactgtgggtctgccgggtcaaagagttcggcccgctgattgtctctattgatacccacggcaacaacctgatagccgaaaacaaaaagctgttcgccgaacgccgcgatcccatcgtggaagagatctgcgagcacgtccattacatcaaataaccctcccggagaggctcacccctctcctttttcgcaggcataacacgatgaaaccttccactgaatggtggcgatatcttgcgccgctggcggtcatcgccattattgctctacttccggttcccgcagggctggagaaccatacctggctctactttgccgtttttactggcgtgatcgttggactgatcctcgaacccgtgccgggtgccgtggtggcgatggtgggtatatccatcatcgccatactctctccctggctgctgttcagcccggagcagctcgctcagccaggctttaaattcactgcaaaatccctctcgtgggccgtttccggtttttctaattcggttatctggctgattttcgccgcctttatgtttggcacaggctatgaaaaaaccgggcttggacgccgcattgcgctgattctggtgaaaaagatgggacatcgcacgctgtttctcggctatgcggtgatgttctccgagctgatcctcgcacctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgactgcgtgaccagcgccattttcttgacggcgatggcaccaaacttgctgttaattggactgatgaaaagcgcatctcacgccacgctgagttggggcgactggttcctcgggatgttgccgctcagcattttactggttctgctggttccctggctggcttacgtgctgtacccgccggtactgaagtctggcgatcaggtgccgcgctgggcagagacggaactgcaggcaatgggcccgctctgttcgcgtgaaaaacggatgctggggctgatggtaggcgcgctggtgctgtggattttcggcggtgattatatcgatgccgcgatggtcggttacagcgtggtggcactgatgctgcttctgcgcattatcagttgggacgacattgtcagtaataaagcggcgtggaacgttttcttctggctggcctcgcttatcaccctcgccaccggactcaacaacaccggttttattagctggtttggcaaactgttagcaggcagcttaagcggttattcgccaacgatggtgatggtggcgttgattgtggtgttttatctactgcgctactttttcgccagcgccacggcgtatacctccgctctcgcaccgatgatgattgctgctgcgctggcgatgccggaaatcccgctgccggtgttctgcctgatggttggtgcggcaattggtctggggagcattcttacaccatacgccaccggccccagtccgatttactacggcagtggttatctgccaacggcggattactggcgactgggggcgatttttgggctgatattcctcgtattgctggtgattaccggcttactgtggatgcccgtggtgttgctttaagtgaggacggtgccggaaattgctctccggcacccaatagttttacgcagccggtaactccgccagcggccagcgcggacgcacgctaacgccgagatccgccgtcgcgcctgctttaaaccgcaccattccggcataggcgatcatcgcgccgttatcagtacaaaattccggacgcgcgtagaacacttcgccgcggcgttttttcatcatttcagccagcttcgcccgtaacgtacggttagcactcacgccgcccgccatgaccagtcgcttaaagcccgtctgatccagcgcccgcttgcacttaatcatcagcgtatcgaccaccgcatcttcaaaggcgcgggcgatatcagcacgcgtctggtcgtcggtgccgttgtcacgaatggtatttgccgcgaaggttttcaggccggagaagctgaaatccagccccggacggtcggtcatcggacgcgggaagacaaagcgcccggcagtaccctgagccgccattttcgacagtaacggcccgccaggataatccagccccagcagcttcgcggttttatcaaacgcttccccggcggcatcatcgatagactcgccgagcagctcgtactgaccaatgccagtcacgctgattaactgcgtatgaccgccggaaacaagcagcgcaacaaacggaaattccggcgggttatcttccagcatcggcgctaacagatgcccttccatatggtgtacagggatcgccggaacgtcccaggcaaacgccagagaacgccccacggtcgcgccaaccagtagcgcgccgactaatccagggcctgcggtataggccacagcatcaatgtcttttgccgttaaaccagactcctttagcgccgcctggatcaacggtacggttttacgcacatgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccctggagaaagcctcgtgtatactcctcacccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtccttcaccgttaacggtgagaaacagttttaccactgctttggatgtggcgcgcacggcaacgcgatcgacttcctgatgaactacgacaagctcgagttcgtcgaaacggtcgaagagctggcagcaatgcacaatcttgaagtgccatttgaagcaggcagcggccccagccagatcgagcgccatcagaggcaaacgctttatcagttgatggacggtctgaatacgttttaccaacaatctttacaacaacctgttgccacgtctgcgcgccagtatctggaaaaacgcggattaagccacgaggttatcgctcgctttgcgattggttttgcgccccccggctgggacaacgtcctgaagcggtttggcggcaatccagaaaatcgccagtcattgattgatgcggggatgttggtcactaacgatcagggacgcagttacgatcgtttccgcgagcgggtgatgttccccattcgcgataaacgcggtcgggtgattggttttggcgggcgcgtgctgggcaacgatacccccaaatacctgaactcgccggaaacagacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggccgtcagctacgctttatgtttttgcctgatggcgaagaccctgacacgctagtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactaccattgatatcgcaagtgccgggcgaaacgctgcgaatatatcttcgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgttggtcccgccgcttgagaatctggatgaaaataagctccctggacttggcttattcagagaactggtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactgcgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatctggcacctaccgccactcacgtcggttctgagctttcccaggaagatctggacgatgacgaagatgaagacgaagaagatggcgatgacgacagcgccgatgatgacaacagcatcgacccggaactggctcgcgaaaaatttgcggaactacgcgctcagtacgttgtaacgcgtgacaccatcaaagcgaaaggtcgcagtcacgctaccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcaaaaactgcagcagattgaagaagaaaccggcctgaccatcgagcaggttaaagatatcaaccgtcgtatgtccatcggtgaagcgaaagcccgccgtgcgaagaaagagatggttgaagcgaacttacgtctggttatttctatcgctaagaaatacaccaaccgtggcttgcagttccttgacctgattcaggaaggcaacatcggtctgatgaaagcggttgataaattcgaataccgccgtggttacaagttctccacctacgcaacctggtggatccgtcaggcgatcacccgctctatcgcggatcaggcgcgcaccatccgtattccggtgcatatgattgagaccatcaacaagctcaaccgtatttctcgccagatgctgcaagagatgggccgtgaaccgacgccggaagaactggctgaacgtatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcaaaagttctgcgtatgcgtttcggtatcgatatgaacaccgactacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaatcggtaggccggatcaggcgttacgccgcacccggcactaggccctctgcacaaacgccaccttttcggtggcgttttttatcgcccacgcactaccagcgcctggtccagctcgcgatacgcttcaaccagtttctccagtgaaacgcgacttaaaccgctgggatttggcagcacccaaatctgcgtcgaaccaatggtgagcgtttgtttcccccactgtgcaccgcgctggctgaatccctgttcatatgcttgtttgcccagaatcgccaacgcctgcggctgataatcttcaattttttcaatcagcttacgcccgcctgcgtgtagctcctgctttgaaacttcattggcttgcaccgttggacggtctaccagtttggtgacgccacaacgataatccagcagatgctgtgcctcctgcggcttcaactgacggtcggtaaacccggcctgatatatcaccttccagaagcgatttgccggatgagcaaagggaaaaccagtcccggcggatgaaagcccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagatatagcaaaggctgacgagaaatcgtcagcctttttctttttatatatcagttactttgcgtgccagtaagccgctgcacgtacccgctgtgggtcatactgttccgcttcaaagcggcggcttaaattcttaacgactttaccttcgccggttatccagatgaagtaatcatcggcagggatttgcatctgcgccagacgcgcatctaccgcctgctcatcatgtgccagccattcgatattaaaaccatcaaggtgcgcgagataatcctgacaggcgttatcccgcacgctaaccagcgcactaacttgcggtttaacggcaagtttgctcaacgtttccaggcggcggcgcaatgcaggcattccggattcatcgcagacatacagctgatacgcgtaatcttccggcaccaccagcgaaccgcgcggacctgccaccgtaagtttatcgcccggttgcgcctgcatcgcccagccgctggcgaccccaccgtcgtgaataaagaaatcaatcgccagttcatggcgtagttcgtcatacagcggcgtatagtcacgcgacggtgggcgtggtccttccggccagacgatgccctcttccgttaccgttggcggcacaaagtgagcgtcaggttgaggaaagaagagtttgctgtgatcgtcaaagccacgcgatgtaaaaccgtccagcgcctcgccgccgaggacaatgcgctgaaaaccggcgctgatgcgctcaacgcgtaacacagtcagttcacggaagcgcagatcattgcgaacgcgctgcgggtagcggggggtgttattcattgttatcgccttcgtgatggtaatcagatatatctaaataaaactcgcaaatgataatgattgttaatcatgataaatgcaagcgatttgtagaactgatatgtctatagtctgataagacgaaccgcctcttctcaggcatcattactcaacgccggatgcggcgtgaacgccttatccggcctacgtgtgagatgagtccacgtttaaaaatcatttttacacttgcaagaacgctcatatcagatataaattagatatatctaattaagcaaaaggaggctgatatgagccatcatcacgaagggtgttgtaaacatgaaggccagccacgccatgagggctgctgcaaaggtgagaagtcagaacacgagcactgcggacacggtcaccagcatgaacacggtcaatgctgcggtggtcgccacggtcgcggcggcggtcgtcggcaacgtttctttggtcacggtgaattacgtctggtgattctggatattctctcgcgcgatgacagccacggttacgaattgattaaagcgattgagaatctaacccaggggaattacaccccaagcccgggcgtcatctacccaacgctggattttctgcaggagcagtcgctgattaccatccgcgaagaggaaggaggtaagaagcagattgcgctgaccgaacaaggcgcgcagtggctggaagaaaaccgcgaacaggtggagatgattgaagaacgcatcaaagcgcgttgcgttggcgcggcgctgcgccagaacccgcaaatgaagcgggcgctggataattttaaagcggtgctggatttacgcgtcaaccagagcgatatcagtgatgcacaaataaaaaagatcattgcggtgatcgaccgcgccgcttttgatattacgcaactggattaatcgccgcatccgccagtggcgcggtgcaattgccggatgcgacgcttgacgcgccttatccggcctacacccgctacacaccccgcaggcctgataagatgcgccagcatcgcatcaggcattgtgctccaaccgccggatccggcataccgattaatgcagtaccgtcaccgcgtcttccagtcggctggcgcggtgtttcaccatcgccgacacctgcgcactctcttccaccagctcggcatttttctgggtgatcaggttaagctcatccactgcacgggtcaggctggaaagcccatcggcctgttccagcgttgaatggctaatctgggcgatcaactgggtgacgtttttcacctgtgccacaatatcttccatcgtccgtccggcggcgtgtacctgctgcgaaccggattgcaccttatcagcactggcatcaatcagcttgcgaatatcgttggcagcattagcgctgcggctggctaaatgacgcacttcccctgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcgatatcgtccattgtcttgatcaccgtggtcatcgcctccccaccctgcactgccgcattactggcagtgattgacagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccatttctgacactggacacctggcttgagacatcgttaattagccaacggcacatcaggccaagttgccctaccgcacgtaatgtcagccccagctcatcgctgcgattcagatgctcaacactattacgttctccggtcgccaccttcagtgcctgatgggcaacattttctatcgggcgcacaatctgccattcaaaacaggcgcttgccaacaataccactaacgcacagaggatatacgtcaccaccggggcagcaacaaaccaaagcatggccgccagcaagataaacatcagggtcatcactccacgcgcccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcaccatttttgcggcgatttttcacgatgccgctccagggctccccttttttcagggtgaaccacatatccgcaaacgccgcttttggcatatccgggtgacgcaccatgttgtgcggctgcccttgtaactcttgcaaggtatagccgctcacctgcacaaaagtgtcattagcatgagtgatatagctttgcagatcggtagtggacatcagagtggtatcgtccgccagcggggtattttgctgggtgacatacggatgagaagacatgttcgcgtcctgtgcaggttatatggttgttaacttcttgtcagagtttatgtcggccccgctgcggttatctttaaccgattaatttgatttagatcgcaatttgcgatttaaacacaaatctaattccttgatttaaaatactttcactctgttactatacgaaaacgttaattatcttgcccaaaaatcaggcaattattgccctgaaaacgtgcatttgcgcagcaatcatcaaatccatacccgacaaaaaccgtgcaaaataacaacaaatgttaacagatagcattaaatattgcacaaatgataaccgaatttgtgtttatcccgattttcgcgatcgcagccggagtggcgcaatccctgcaatacttaaatcggtatcatgtgatacgcgagcctccggagcatattttgaacaggttaccttcgagcgcatcggctttagcgtgcagcgcccacgccctgaatctcattgagaagcgaacgctggatcatgaggagatgaaagcacttaaccgagaggtgattgaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaatatcaaatcggatggcgatacgacgtcgccatccgatctttttatacgacgcgtacgcccgcaggcatcatccgctccggcgttaacagcacgctttcactgccgtcatcggtttccgcacacaacagcatgcattccgacgtttcaccacgcattttcgctttttgcagattgcataagaccaccaccgttttccccatcagctcttcttcgctgtagtacggcaccaggctggtcacggtttgcagcgttttttgccccacatcaacctgtacgatgtacagcttgtcggcgttttcatggcgtttcacttccacaatctttccgacgcgcatttccagacgtgcaaaatcagcgtaagccacggtttccattgcttcctcccttagggtaaaattttactaaactatagcaaaagtttttctcaatcctgtaggctaaaaatggagaatgcaggcgtgatcacattcgtgagccgctgtgttaccgttacagcgtcaaagaaacgcgctttatttactgaaaacaggtgacccgataagcacttcctctacaatgggggcgcacatcagggaaagtaaaaaaggtaaacatggcaacactaaaagacatcgcaatcgaagctggcgtatccctggcgacagtatccagggtcttaaatgacgatccgacattgaatgtgaaagaagagacgaaacatcgcattctcgagatcgccgaaaagctggagtacaagaccagtagtgcccgtaaactccagacaggtgcagtcaaccaacaccatattctggctatctacagctaccagcaggagctggagatcaacgatccttactatctggcgatccgccacggcattgaaacccagtgcgaaaagctgggcatcgagctcaccaactgttatgaacacagcggcttaccagacattaaaaacgtcaccggtattttaattgtcggcaaacccacgcccgccctgcgcgccgctgccagcgcgttgaccgacaatatctgttttatcgactttcacgaacccggcagcggttacgatgcggtggatatcgatctggcacgcatcagtaaagaaatcatcgacttctatatcaaccagggcgttaatcgtattggttttattggcggtgaagatgagcctggcaaggcggatattcgtgaggtcgcctttgcggaatatggccgactgaaacaagtggtacgcgaagaggatatctggcgcggcggtttttccagttcgtcgggttatgaactggcaaaacaaatgctggcgcgggaagactatccgaaggcactgtttgttgcttccgattccattgctatcggcgtactgcgggcaattcatgaacgaggcctgaacatcccacaggatatttcgcttatcagcgttaacgatatccccaccgcgcgatttacctttccgccgctctccaccgtgcgcatccattccgagatgatgggaagtcagggcgttaacctggtgtatgaaaaagcccgcgatggtcgcgcgctgccgctgttagtcttcgttcccagcaaattaaaactgcgcggcacgacccgttaaatccccttacacactgtccggcaatcgtttttgccggacagtgctgccgtttattttcgtgatccagttaaagtaaatgcatttacctgctactttttagtaaaaattttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcgcaagcgcgtacctttgcccgcgaaaccagcagcctgtttctgcccttaagcggtcagtggaatttccacttttttgaccatccgctgcaagtaccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctatgttaacggtcagtatgtgggtttcagcaagggcagtcgcctgaccgcagagtttgacatcagcgcgatggttaaaaccggcgacaacctgttgtgtgtgcgcgtgatgcagtgggcggactctacctacgtggaagaccaggatatgtggtggtcagcggggatcttccgcgatgtttatctggtcggaaaacacctaacgcatattaacgatttcactgtgcgtaccgactttgacgaagcctattgcgatgccacgctttcctgcgaagtggtgctggaaaatctcgccgcctcccctgtcgtcacgacgctggaatataccctgtttgatggcgaacgcgtggtgcacagcagcgccattgatcatttggcaattgaaaaactgaccagcgccagctttgcttttactgtcgaacagccgcagcaatggtcagcagaatccccttatctttaccatctggtcatgacgctgaaagacgccaacggcaacgttctggaagtggtgccacaacgcgttggcttccgtgatatcaaagtgcgcgacggtctgttctggatcaataaccgttatgtgatgctgcacggcgtcaaccgtcacgacaacgatcatcgcaaaggccgcgccgttggaatggatcgcgtcgagaaagatctccagttgatgaagcagcacaatatcaactccgtgcgtaccgctcactacccgaacgatccgcgtttttacgaactgtgtgatatctacggcctgtttgtgatggcggaaaccgacgtcgaatcgcacggctttgctaatgtcggcgatattagccgtattaccgacgatccgcagtgggaaaaagtctacgtcgagcgcattgttcgccatatccacgcgcagaaaaaccatccgtcgatcatcatctggtcgctgggcaatgaatccggctatggctgtaacatccgcgcgatgtaccatgcggcgaaagcgctggatgacacgcgactggtgcattacgaagaagatcgcgatgctgaagtggtcgatattatttccaccatgtacacccgcgtgccgctgatgaatgagtttggtgaatacccgcatccgaagccgcgcatcatctgtgaatatgctcatgcgatggggaacggaccgggcgggctgacggagtaccagaacgtcttctataagcacgattgcattcagggtcattatgtctgggagtggtgcgaccacgggatccaggcacaggacgaccacggcaatgtctggtataaattcggcggcgactacggcgactatcccaacaactataacttctgtcttgatggtttgatctattccgatcagacgccgggaccgggcctgaaagagtacaaacaggttatcgcgccggtaaaaatccacgcgcgggatctgactcgcggcgagttgaaagtcgaaaataaactgtggtttaccacgcttgatgactacaccctgcacgcagaggtgcgcgccgaaggtgaaacgctcgcgacgcagcagattaaactgcgcgacgttgcgccgaacagcgaagcccccttgcagatcacgctgccgcagctggacgcccgcgaagcgttcctcaacattacggtgaccaaagattcccgcacccgctacagcgaagccggacaccctatcgccacttatcagttcccgctgaaggaaaacaccgcgcagccagtgcctttcgcaccaaataatgcgcgtccgctgacgctggaagacgatcgtttgagctgcaccgttcgcggctacaacttcgcgatcaccttctcaaaaatgagtggcaaaccgacatcctggcaggtgaatggcgaatcgctgctgactcgcgagccaaagatcaacttcttcaagccgatgatcgacaaccacaagcaggagtacgaagggctgtggcaaccgaatcatttgcagatcatgcaggaacatctgcgcgactttgccgtagaacagagcgatggtgaagtgctgatcatcagccgcacagttattgccccgccggtgtttgacttcgggatgcgctgcacctacatctggcgcatcgctgccgatggccaggttaacgtggcgctttccggcgagcgttacggcgactatccgcacatcattccgtgcatcggtttcaccatgggaattaacggcgaatacgatcaggtggcgtattacggtcgtggaccgggcgaaaactacgccgacagccagcaggctaacatcatcgatatctggcgcagcaccgtcgatgccatgttcgagaactatcccttcccgcagaacaacggtaaccgtcagcatgtccgctggacggcactgactaaccgccacggtaacggtctgctggtggttccgcagcgcccaattaacttcagcgcctggcactatacccaggaaaacatccacgctgcccagcactgtaacgagctgcagcgcagtgatgacatcaccctgaacctcgatcaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgttgaggtccacgaagggcaaatcgttatttgcgatatccatgaagcgtatcggtttatctgcaataacgcggtcaaaaaagtggttctcaaagtcaccatcgaagatggttatttccataacaaataacaactacggcggcaaaaggagtttgccgccaccgctaccctactcattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcatcgcagaatttgtttcgttaaataaaaactcagaagccggtgtctacgcgtgggtaaaaagttcgctgggcggacgttgggcatttattactgcctatacctactggttcgtaaacctgttctttttcacctcactgttgccgcgcgttattgcttatgcttcgtatgccttcctcggatacgaatatattatgacgccggttgccaccaccattatcagtatggtgctgttcgccttctccacctgggtttccaccaacggggcgaaaatgttggggccaattacctccgtcacttcaacgctgatgctgctgttaacgctctcctacattttactggcaggtacggcgctggttggcggcgtacagcctgctgacgccatcaccgttgacgcgatgatcccgaacttcaactgggcgttcctcggcgttaccacctggatctttatggccgcaggtggcgcggagtccgtcgctgtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttaccggcggatcggtgcaggtattccacggcatggcggcgtattttggtctaccggaagcgttgatgaatcgctttgtcggtctggtgtcctttaccgcgatgttcggttccctgctgatgtggaccgcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgaccgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttccttggctttgcgtggtggaaatacagtaaatatataaagggattaacggctgaagagcgccatattgaagcgacgccagccagcaatgttgattaagcagaataataaaaaatgagcaggcattttccctcttcctggatgaggagagggaaaatagtttctgcctttatatttttataattacaacgataaaaggctgtactttttctttagctcatggattaacacaatgaaattaatcactgcaccatgcagagcattacttgctctgccgttttgctacgccttttctgcggcaggagaagaagcacgtccggcagaacatgacgacacaaaaacacccgcaattacctcgacatcttctccttcatttcgtttttacggcgaattaggggttggtggatatatggatttagagggtgagaataaacataaatacagcgacggtacctatattgaaggtggcctggagatgaagtacggctcctggttcggcctgatttacggcgaaggctggaccgtgcaggccgaccacgacggcaatgcctgggtgccagaccatagctggggtggtttcgagggcggaattaaccgtttctatggcggttatcgtaccaatgatggcaccgaaatcatgctcagtctgcgtcaggattcctcgctggatgacctgcaatggtggggcgatttcacccccgatctgggctacgtcattcccaatacccgcgacattatgactgcgctgaaggtacagaacttaagcggcaactttcgttatagcgtcaccgcgactcctgccggacatcatgatgaaagcaaagcctggctacattttggcaaatacgatcgctatgacgacaaatacacctatccggcaatgatgaacggttacatccagtatgaccttgccgaaggcatcacctggatgaacggtctggaaatcaccgacggcacaggacagctctatctcacgggcctgctaactcctaactttgccgctcgcgcctggcaccataccggacgcgccgacgggctggacgtaccgggaagtgaaagtgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgccacggcttttgatagccgcttctacatgaaaaatgcctctcacgatcccagcgaccaaatcttcctgatgcaatatttctactggtaataaggactgtaatttcatgaaaataaaaactattttaacgccagtaacctgcgctctgctgataagtttttccgcccatgccgctaacgccgacaattataaaaacgtgattaaccgtactggcgcgccgcagtacatgaaggattacgattacgacgatcaccagcgttttaatccgtttttcgatctcggagcctggcatggtcatctgttgccagacggccctaacaccatgggcggctttccgggcgttgcgctgctgacggaagagtacatcaactttatggccagcaatttcgaccgcctgaccgtctggcaggacggcaagaaagtcgactttacgctggaggcatacagtattcccggtgcgctggtgcaaaaactgacagcaaaagatgtgcaagtcgaaatgactctgcgcttcgccacgccgcgcacgtcactactggaaaccaaaatcaccagcaataaaccgctggatctggtgtgggacggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggcgaatcggaatatcaggtgcataaatccctgccggtgcagactgaaatcaacggtaatcgctttaccagtaaggcgcatatcaacggttcgaccacgctctacaccacctattcccatctgctgaccgctcaggaagttagcaaagagcaaatgcagatccgcgatattctggcgcgtccggcgttttatctcaccgcctcgcagcaacgctgggaagaatacctgaagaaagggttaaccaatccggatgcgacgccggaacagacgcgcgtcgcggtgaaagcgatcgaaacgctcaacggtaactggcgctcaccgggcggtgcggtgaaatttaacaccgttacaccgtcggtgaccgggcgctggttctccggcaatcagacctggccgtgggatacctggaagcaggcgtttgcgatggcgcatttcaatccggacatcgccaaagagaatatccgcgcggtcttctcctggcagatccagcctggcgatagcgtgcgtccgcaggatgtgggctttgtccccgacctgatagcgtggaaccttagccccgagcgtggtggcgatggcggcaactggaacgaacgtaataccaaacccagccttgccgcctggtcggtgatggaagtgtataacgtcacccaagataaaacctgggtggcagagatgtacccgaaactggtggcctatcacgactggtggttacgtaaccgcgatcacaacggcaacggcgtgccggaatatggcgcgacccgcgacaaagcccacaacactgagagcggcgagatgctgtttacggtgaaaaaaggcgataaagaagagacgcagtctgggctgaacaactacgcccgcgtggtggagaaaggccagtacgacagtctggaaattccggcacaggttgctgcatcgtgggaatcggggcgtgatgatgccgccgtctttgggtttatcgacaaagaacagttggataaatatgtcgctaatggcggcaaacgtagcgactggacggtgaaattcgccgaaaaccgcagtcaggacggaacgttgctgggctactcgctattgcaggagtcggtggatcaggccagctatatgtacagcgataaccattatctggcggagatggcaaccatcctcggtaagccagaagaggccaaacgctatcgccagttggcacagcagctcgcggactacatcaacacctgtatgttcgacccgactacccagttctactatgacgtacgtattgaagataaaccactggcgaacggctgcgcgggcaaaccgattgttgagcgcggtaaagggccggaaggctggtcgccgctgtttaacggtgcggcaacgcaggccaatgccgacgcggtggtgaaggtgatgctcgatcctaaagagttcaacacctttgtcccgctgggaacggcggcgttaaccaatccggcttttggcgctgatatctactggcgtgggcgcgtatgggtggatcagttctggtttggtctgaaagggatggagcgttacggttatcgtgatgatgccctgaagctggcggatacgttcttccggcacgccaaagggttaaccgccgatggaccaattcaggaaaattacaacccgctgacaggcgcacagcaaggcgcaccaaatttctcctggagtgccgcgcatttgtatatgttgtataacgattttttccgtaagcaataatttgcaactgctggcggatgcggcgtaaacgccttatccgccctacatgtgcaatcctcctggccggataaaacgcggcaagcgttgcatccggcaactgcaccgcgccactggcggatgcggcgtgaacgccttatccgccctacatgtgtgttcccgtaggtcggataagacgcgacaagcgtcgcatccggcatctgcaccgcgccactggcggatgcggcgtggacgccttatccgccctacatgtgcaattccgtaacctggataaaacgcgacaagcgtcgcatccggcgttatcaccgggcgtattctttttgaatcccatcacaaaccccgcactccccttttcccttttctccggcgacggctaaattagaactcatccgaccacataacaattattttacatactggacaattttatgagctacccgtcgctgttcgccccgctggatttaggttttaccacgttaaaaaaccgcgtgttgatgggctcaatgcacaccgggctggaggaatacccggacggtgccgagcggctggcagcgttttatgccgaacgcgcccgtcacggcgtggcgctgattgtcagcggcggcattgcaccagatttaacaggcgttggcatggaaggtggcgcaatgctcaacgacgccagccagatcccacaccatcgcaccattaccgaagcggtacatcaggaaggcggcaaaatagccctgcaaattttgcataccgggcgctacagctaccaaccgcatctggtcgccccgtccgcattgcaggcccccatcaaccgtttcgtgccccatgagttaagccatgaagagatcctgcaactgatcgacaatttcgcccgctgcgcgcaactggcgcgggaggcaggatacgacggtgtagaggtgatgggttccgaagggtatttgatcaacgaatttctgacgctgcgcaccaatcagcgtagtgaccagtggggcggcgattaccgcaaccggatgcgatttgccgtagaagtagtgcgtgcggtgcgcgaacgcgtcggcaacgacttcattattatctaccgactgtcgatgctcgacctggtcgaagacggcgggacttttgccgaaacggtagagctggcgcaggccattgaagcggcgggcgcgaccattatcaacaccggcattggctggcatgaagcacgtattccgaccattgccacgcccgtgccgcgcggcgcatttagctgggtcacgcgcaaactgaaaggccacgtctcgctgccgctggtaaccaccaaccggattaacgatccgcaggttgccgacgatattctctcgcgcggcgatgccgatatggtatcgatggcgcgaccgtttcttgctgatgcggagctgctgtcaaaagcgcaatcgggacgagccgatgagatcaacacttgtattggctgcaatcaggcctgtctcgatcaaatcttcgttggcaaagtcacctcgtgcctggtgaatcctcgcgcctgccacgaaaccaaaatgccaatccttcccgccgtgcagaaaaaaaatctggcggtggtcggtgcgggacctgctgggctggcgtttgccattaacgcggcggcgcgtgggcatcaggtaacattgtttgacgctcatagcgagattggcgggcagtttaatatcgccaaacagatccccggcaaagaggagttttacgaaacgctgcgctattaccgccggatgatcgaagtgacgggcgtgacgctaaaactcaatcacaccgtgacggcggatcagttacaggctttcgatgaaacgatcctcgccagtgggatcgtgccgcgcactccgcccatcgacgggatcgatcatccgaaggtattgagttatctcgatgtactgcgcgacaaagcgccggttggcaacaaagttgccatcatcggttgtggcgggattggttttgatacggcgatgtatttaagtcagccgggcgaatccaccagccagaatatcgccgggttctgtaatgaatgggggatcgacagtagcctacaacaggctggtggcttaagcccgcagggaatgcagatcccccgtagcccacggcagattgtgatgctccagcgcaaagccagcaaaccaggacaggggttaggcaaaaccaccggctggatccatcgcaccaccctgctctcgcggggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcgctggcgcaaccgctgattgatagcgggaaaacggtgcatttaattggcggctgcgatgtggctatggagctggacgcacgacgggcaattgcccagggaacacggctggcgctggagatttaaatcgttatttgaagcgccggatgcaacgcatccggcacgtcgcgttaatcaataaacaaggcgggagaaatgccgaatcgcgttgccaattttttagcgtgttccagcgttaatttcctcttcccgctcaaaacgcgtgacaccatagatttactgccaatttccggcagatcggaaagggttaaaccatattgatccataagggtacgaatcacggctataccgccaggcatggcttgagccatggcattaaattccgcaaattcgggcgctgattcttcccacgcggttattttggcacacaccagatccagcaaggggttttcaggatcgttgagcagcagatgatctaccagttccagcgcctgggtgtattgttcctcgttctgaatacccgccagaaaaggtgccacagcagttagcttttctcctgcttgcaagatgtcggcaatcgcaatcattttttccccttagtacgatgaacagcggtaaagaaatcgtattctttatgcgtcataacttcacgtatgtagcacttttgcgattcaaaaaagaccattgctacaacacgtaattcattgcccccaacattgaaaacataatgcttatccagatatttgaagttatccagagatgggaatactgcttttaatgactcaggttttttgaaatatcccttagcaatcgtgttccccagagccaccaactccgttttatgttgcgggtatttttccgcagcatctttcaatgctttttgagttatcaggtgcattcttcatcacgtccgttgacaaattggcaatatgataacatccgttgccagattggcaacggatgaatttatctgtgtgacggaagaataaacgtagaaaaacgctaaacaagagaatgtagacgatggtgacagggattttttgttttatggaagcgcgattccagaactgggcagacattgccggatgcgacgcttgccgcgtcttatccggcctggagtaacgtgctgaacgtaggccggataaggcgtttacgccgcatccggcaggtaactcccaatcttaccgacgacgtcccagcttcaccgctttcagtaccacaaatttattattcgtcgcaatagtggtgcagttgccgaaaatcttcttcagtttatggaagtaatccaggtgacggttggcaacgatatacagctcgccgttgattttcaggcagcggcgggcgtggtggaacatctcccaggcgacgttatcggtcagcgcatgttgttggtgaaacggcgggttgcagagcacagcattaaagcggaaaggctccacgccggagagcgcgttgttgatcataaactcgcagcgatccaacgcctctggcatgttggtttcaacgttcaaacggctggaagcaaccgccatcggcgattcatcgacaaacaccactttcgcctgcgggtttttatcaagcagcgtcagaccaataacgccattaccgcaaccgagatcgacaatctccccttcgagattctctggcagatgttgcataaagaagcgcgcgccgatatcaagcccggtgcgggagaagacattcgcatggttgtggatagtccagtcagtaccttccagcttccagctaacggtctgcggcgcatcggccagctgcggttcattgaaagtgcaattaatcaggcgcgcttttttccatgccagcgtggtggtggttgggccgagcactttttcgaacagttccagcgtggaagtgtgaatgtcacgggccttggcaccggcaataatacgtgtatccgacgtgaccactttgcgcagcgcacgcagttgctgttccagcaatgccagtgttttcggcactttgatcagcaccacacccggctgttgcgggtagtcggcggtgctgtcgagaaacttcacgctcgactcatcaatcccgttgaggcgtaaattctcgcgcgtcgccagttcactgatgtatgagtcgccaatgctgtacggcttatgttccgccagtgcgcagcttaacgcaccaaaggcatcattcaggatcaacaccgggccgcggatttctgtgtcgtccaactgttgcagcaaatattcatccgccgcttcccacgcctgtagcgggttaacgtcatccgtcgccggaaaacgttgtagtgtcagtgaacggaaaccgttgtctaagtggctcatcggccctcctgaatgataaaatttcgacattgcccctgaaaagggtgcgtgagtataccctttttctctttttcgtgggcggttatgagcaatcttacttatcttcagggttatcccgagcagctactttcccaggtgcgaacactgattaacgaacagcgtctgggcgatgtgctggcaaaacgctatccgggaacacacgactacgccaccgataaagccctctggcaatatactcaggatctgaaaaatcagtttctgcgtaatgccccgccgatcaataaagtgatgtatgacaataagatccatgtgctaaaaaacgcgctcgggttacataccgctgtttctcgtgtgcagggcggcaagctgaaagcaaaggtggagatccgcgtcgctaccgtgtttcgcaacgcgccggaaccgtttttgcgcatgatcgtggtgcacgagctggcgcacctgaaggagaaagagcataacaaagcgttttaccagttgtgttgtcatatggaaccccagtaccaccagcttgagttcgacacccgactgtggctaacgcagttgtcgcttgggcagaacaaaatctgaaaatgatgtcaggcgttatcttttctttctttagcgcctaaaatcgacctcccccctttcgttaaggataacgaccatgctgcgcgcatttgcccgccttcttctccgtatttgtttttctcgccggactctaaagattgcctgcttactgttacttgtggcaggagcgaccatccttatcgccgatcgcgtaatggtcaacgccagcaaacagctgacctggagcgatgtcaacgccgttccggcgcgtaacgtgggtttattgctgggggcgaggccgggtaatcgctactttacccgacgtattgataccgcagcagcgttgtaccacgccggaaaagtgaaatggctgctggtaagtggcgataacggacgtaaaaattacgatgaagcatcaggtatgcagcaggctttgatcgctaaaggcgtaccagcaaaagtgatcttctgcgactatgccggattctcaacgctggattcggtagtgcgtgccaaaaaggtttttggtgaaaaccatatcaccattatctcgcaagaatttcataatcaacgcgccatctggctggcaaaacagtacggcatcgacgctatcggttttaacgcgccagacctcaatatgaagcacggtttttatactcaactgcgggagaaactcgctcgtgtcagcgccgtgattgacgccaaaatcctccatcgccagccgaaatatctcgggccttcggtcatgattgggccgtttagtgagcatggctgtccggcgcagaaataatgcgtatctgcgcacgtcgaagatgaaaaaggcgtgctacattgacgacagaatccctttatggagtatccacgcgttatgatacgtttcgctgtgattggtacgaactggatcactcgccagttcgtcgaggccgcccatgagagcggtaaatacaagttaaccgccgtatattcccgcagccttgaacaggcccagcacttcgccaatgatttttctgtcgagcatctgtttacctcgctggaagcgatggcggaaagcgatgccattgacgcggtgtatattgccagcccgaattccctgcatttttcccagacacaacttttccttagccataaaattaatgtgatttgcgagaaaccgctggcgtcgaatctggcggaagtggatgccgccattgcctgtgcgcgggaaaatcaggtggtgctgtttgaggcatttaaaaccgcctgcctgccgaactttcatttgttgcgccaggcgctgccgaaagtcggcaaactgcggaaagtctttttcaactattgccagtattcctcgcggtatcaacgttacctggatggtgagaatcccaacacctttaatccggcattctctaacggttcaattatggatatcggtttttactgtctggcgtcggcggtggcgttatttggtgagccgaaaagcgtgcaggcaaccgccagtttgctggcaagcggcgttgacgcccagggcgtggtggtgatggattacggtgatttcagcgtcaccttgcagcactcaaaagtcagtgattctgtcctggcgagcgagattcagggcgaagcaggatcgctggtgattgaaaaactgtctgaatgccagaaagtgtgcttcgtgccgcgtggcagccaaatgcaggatctcacccagccgcagcatattaataccatgctctacgaagcagagctgttcgctaccctggtggatgagcatctggtggatcatccagggctggcggtcagtcgcatcaccgccaaactgctgaccgagatccgccgccagactggggtgatttttccggcagatagcgtaaaactataattgccaaagtaaaacagtgtaaaaggtatgtaacagaccattgactggctgaatggtctgtcatactttgttacctgcaaaggggagtaacttcattgccggtcgatcgtcattacgatgtgtgaaaaaacacatccggtcaccgggcaacccgaaaggaatacgcagacgtattccttttttgttgtaagtgagaccttgccggaaggcgaggtctatgcataaaaagcagcggctgacgtcttccgacgttggccgtttttttatgtgtaaggaacttctatgaatactgtcggcacgccgttgctatggggcggattcgctgttgttgtcgccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacaggttatctgattgagaaatcgctggcggtcgataacgtctttgtctggctgatgttgttcagctatttctctgttccggcggcattacaacgccgcgtgctggtgtatggcgtgctcggggcgattgttctgcgtaccatcatgatcttcactggcagctggctaatttcgcagttcgactggatcctgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggattgctgtacgccacaccgctgatgctggtactgattctggtggaattgagcgacgtgattttcgccgtggatagcattccggctatcttcgccgtgaccactgacccgttcattgtgctgacctcaaacctgtttgcgatcctcggcctgcgtgcgatgtatttcctgctggcgggcgtagcagagcgtttctcgatgctcaaatatggcctggcggtgattctggtgtttatcggtatcaagatgctgattgtcgacttctaccatattccaatcgccgtctcgctgggcgtggtgtttggcattctggtgatgacgtttattatcaacgcctgggtgaattatcggcatgataagcagcggggtggataatttttaatctgcctaagccgtgtaccctgtcattaacatgagcaccgttttctccctctcccttccagggagagggtcggggtgagggtaatttttcgcaccgatgctggcctgttcccctcaccctaaccctctccccaaacggggcgaggggactgaccgagtccttttttgatgttgtcatcagtctggaagccgcacgttggctttatttttatgtcaaagaaatgtaaccattaagtttcaaaatatgacctctctttaaaatccagcatttttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacgttcaccggggctattccggcgtctggctcatggcagcctggtaaaacaaatcctggtcggccttgttctggggattcttctggcatggatctcaaaacccgcggcggaagctgttggtctgttaggtactttgttcgtcggcgcactgaaagccgttgcccccatcctggtgttgatgctggtgatggcatctattgctaaccaccagcacgggcagaaaaccaatatccgccctattttgttcctctatctactgggcaccttctctgctgctctggccgcagtagtcttcagctttgccttcccttctaccctgcatttatccagtagcgcgggtgatatttcgccgccgtcaggcattgtcgaagtgatgcgcgggctggtaatgagcatggtttccaaccccatcgacgcgctgctgaaaggtaactacatcgggattctggtgtgggcgatcggcctcggcttcgcactgcgtcacggtaacgagaccaccaaaaacctggttaacgatatgtcgaatgccgttacctttatggtgaaactggtcattcgcttcgcaccgattggtatttttgggctggtttcttctaccctggcaaccaccggtttctccacactgtggggctacgcgcaactgctggtcgtgctggttggctgtatgttactggtggcgctggtggttaacccattgctggtgtggtggaaaattcgtcgtaacccgttcccgctggtgctgctgtgcctgcgcgaaagcggtgtgtatgccttcttcacccgcagctctgcagcgaacattccggtgaatatggcgctgtgtgaaaagctgaatctggatcgcgatacctattccgtttctattccgctgggagccaccatcaatatggcgggcgcagcaatcactattaccgtgttgacgctggctgcggttaatacgctgggtattccggtcgatctgcccacggcgctgctgttgagcgtggtggcttctctgtgtgcctgtggcgcatccggcgtggcgggggggtctctgctgctgatcccactggcctgtaatatgttcggtatttcgaacgatatcgccatgcaggtggttgccgtcggctttatcatcggcgtattgcaggactcttgcgaaaccgcgctgaactcttcaactgacgtgctgttcactgcggcagcttgccaggcagaagacgatcgtctggcaaatagcgccctgcgtaattaattgtttaacccctttcgtctacggcggaaggggttttctcaactttaaacggatcaattccccttttctgcatccgccagaaacgaatgatattcaggccattcataagcagaaaactaccctcaatcatcgtgccgcctatcgaccccgcccagaagttgtgaatcacccagcaacacgttgaaaaccacattacgcagcgcatggtcagccctttacagcagaatagcgcccaggtactgacaatcgtgccgataaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccagcgggataggtgcccagaagaaaaaaatgtacgccaataacggcgctatagaccgaaagctgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttacaggtttgcttaccgttggcaaactcaacgatggtgtcgataaattcttccagcaactgcggcatcgctttaccgtggatcaactgacccgcgtcaaagtcgatccagtgttttttcttcgccgccagttcactgttggtggcgattttcaccgtcggcacaaatccaccatacggcgtgccacgaccagtactgaacagcaccatatggcagcccgcacccgccagggcgctggtcgctacggcatcgttacccggcgcacttaacaagttcagccctggcgttttcagacgctcgccgtaacgcagcacgtcaaccacgacgctggaacccgctttctgggtacagccaagtgatttgtcttccagcgtggtgataccgcccgctttgttccccggcgatgggttttcatagatcggctgatcatgggcaataaagtactgtttgaagtcgttgaccatggtgaccagtttttcaaacgttgcttcgtcgcggcaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcctggctcgcgtttatcgttgcgcatcacgttatacagctgatgcaaatgctcgattccggcttcgatctcatcatcctgctgttggcagatcatgaaatgaacgcgttcaggatcgatatcgcccagcgtttcacggaatgcggcaacctggttgttttcacagcccagaccaatcaccagcactgcgcctgcgttcgggtggcgcaccatgttttgcagcatggtgcgggtattaatgtgatcgtcgcccagctgtgagcagccgtaggtgtggctgaagaggaacacgccgtcagtaccttcggcgttgttggtctctttcagaaaacggttctggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacgtgaacacctgccgcaatatccgccaatgcataaccaatcggcaggccatatttgatgacattggccccttttgcgatatccgttaacgcaaatttatgtccacgagcaacatcctggcgcagcgtaacagtctggttatcgacactgacttctgtgccttcagccaaatctgctaaagcgaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcccgcttccacccagcgaccgatcatctggcacagaatgcggcggaagtattcgtgacgggtgtatgacaggaagctacggctgtcagtcagcataccgacaaagcggctcagcagaccgagctgcgccagttgggtcatctgacgttccataccgtctttctgatcgttaaaccaccagccggaaccgaactgcattttgcccggcataccttcgccctggaagttaccgatcatggtgcccagcacttcgttatcgcgcgggttcaggcagtacagaatggttttcggcagcaggttttcttcattctgcttgctcagcaacttagacagctcttccgccatcggacggtcgttgatggagtcaaagcctacatccggccccagcagtttgaactgacgcaggttgttattacgcagcgcgccaatgtggtactgctgtacccagccgcgacgtgcatattcggcaccaaggaacaccagtaccgcagttttgaactgcgccacttcgtgctcgctcagggtttcgccagccagacggcgcgccagaatgctgtccagttccgcttcgttcgcttcagcaaacatcaccacatccagcgcgtggtcagacactttacagccgtgagcggcgaagtgatccagacgtttggtcagggcagtttgcaggtcagcaaagcggcgaatgtcggtatcggaaacttcgcccagcttcgccatgtagtcgttaaaggtcgcctgttcgatgttgaaggctttgtccggacgccagctcggcagcactttgatggtgaaagagccgtctttggcgatctctgcgtgatgctccagagaatcgatcgggtcatcggtggtgccgaccattttcacgttcatctgctgcatgatgccgcgcgcggagaagttatcctgcgccagcagttcgttacattcgttccagatttcatcggcagttgacggagaaagcaatttgccagtgataccaaacggacggcgcagttcgaggtgcgtccagtggtataacgggttgccgatagtgtgcggaacagtcgccgcccaggcgtcaaatttttcacggtcagacgcatcaccggtacacagacgctcggccacaccgttggtacgcatagcgcgccatttgtagtgatcgcctttcagccagatgtcatacaggtttttaaaacgatagtcttccgcaatctgctgcggcggcaaatggcaatggtaatcgaaaatcggctggtcttttgcgtagtcgtgatacagacggcgggcaaattcggtatctaacaggaaatcttcagtcataaacggagtcattttcgtcttcctctcaacgagtgagctagcttgcttatggtgcgatgctgacaaagttatcacaccaatttccagagtccgaagatattttcgtgagttagatcaataaacgtagttaaaaaaattactctcaaagtggtaaatctcgctgcaggccgcgccagtactggccttgctgtcgtcaggtaatgtccctacaaatattcccacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcctattctgctgcttatacggtcatgcaaccggtagcaggttatgtactggatgtgctgggtacgaaaatcggttatgcaatgtttgctgtgctgtgggccgtgttctgtggtgcaaccgcgctggcaggtagctggggtggcctggctgttgctcgtggtgcggtcggtgccgcggaagcagcgatgatcccggcgggtctgaaagccagctccgaatggttcccggcgaaagagcgttccatcgcagtaggctactttaacgtaggttcttcgattggtgcgatgattgcgccgccgctggtggtatgggcaatcgtaatgcacagctggcagatggcatttatcatctccggtgcattgagctttatctgggcgatggcatggctgattttctataaacatccgcgcgaccagaagcatctgaccgatgaagaacgcgactatattattaatggtcaggaagcccagcaccaggtgagcacggcgaagaaaatgtccgttggtcagatcctgcgtaaccgtcagttctggggtatcgcgctgccgcgtttcctggcagaaccggcctggggtacttttaacgcgtggatcccgctgttcatgtttaaagtttacggctttaacctgaaagagatcgcgatgttcgcctggatgccgatgctgtttgctgacctcggttgtatcctcggtggttacctgccgccgctgttccagcgttggtttggtgtgaacctgatcgtttcccgtaagatggtcgtaacgctgggtgcagtgctgatgattggcccgggtatgatcggcctgttcaccaacccgtatgtcgcaattatgctgctgtgtatcggtggttttgcccaccaggcactgtctggcgcgctgattacgctctcttccgatgtgtttggtcgtaacgaagtggcaacggcaaacggtttaaccgggatgtccgcatggctggcaagtacgctgtttgcgctggttgtcggtgcactggctgacaccatcggcttcagcccgctgttcgcagttctggcagtgttcgacctgttaggtgcgctggttatctggaccgtgttgcagaacaaaccggcgattgaggtggcgcaggaaacacataacgatcccgcaccgcaacattaacgtttcgtgtaagttttagtttcccttcaaagccgccttctcaggcggctttttcatcactgcgagtagagctaaactcgcaaaagtggtataacaaatatagtctgccgtatcatgcctggagcgcatatggaaatcactgaaccacgccgtttgtatcaacaacttgccgctgacctgaaagagcgcatcgaacagggcgtctatctggtgggtgataaactgcctgcagaacgctttattgccgatgaaaagaacgtcagccgtacggtagttcgtgaagccatcatcatgctggaagttgaaggctatgtcgaagtgcgtaaaggttcaggtattcatgtggtttccaaccagccgcgccatcagcaggcggctgacaataatatggaattcgccaattacggtccgtttgagttgcttcaggctcgccagctcatcgaaagtaatattgccgaattcgcggcaactcaggtaacgaaacaggacatcatgaaactgatggccattcaggaacaggcgcgcggcgaacaatgcttccgtgattccgagtgggatttgcagttccacattcaggtcgctctggcgacgcagaactccgccctggcggctatcgtggaaaaaatgtggacccagcgtagtcataacccgtactggaaaaaactgcacgaacacattgattcccgtaccgtcgataactggtgtgatgaccacgatcaaatcctcaaggcgctgattcgcaaagatcctcatgctgctaagctggcaatgtggcagcatctggaaaacaccaagatcatgttatttaacgaaaccagcgacgacttcgagttcaatgccgaccgctatctattcgccgaaaacccggtggtgcatctcgatacagccaccagcggcagtaaatgaaattcctgtccgacaggcgctgcaatgcgcctgtttgtctcgtcggtaagcgaaaagtataaagtgtcagcctgtgtaaatcctctcgccaccctcccctgcattcagcaaaatcagactccacggacatgtaattttgataacgaacaacgttgacctttgttacaattagattcaatttgaatttatgtttttgaatgctttcttatctcacgatttaacagggaatagttcaggctgtgttgatgtatcaaacccgcagaacataccaaaacagcaataacattgcggtagtgcatcttttaaaaccagcgtggcgttaaccgattcaccaggaataatgaatggaacttttgacccaattgctgcaagccctgtgggcgcaggattttgaaaccctggccaatccatcgatgattggcatgttgtattttgtcttgtttgtaattttgttccttgaaaacggcttgcttccggcggcctttttaccgggcgacagtttactggtattggtcggcgtgttgattgcgaaaggcgcgatgggctatccgcaaacgattctgctgctgaccgttgccgccagcctcggctgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagtttttcaactggatgagcggtctgctgtgggtattgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcgcttcgccagctagcctggtccggcgctgttttacttctggtcggcacgctgttgctggcctggtccgcggttcgccagcaagagtctacgctggcgattcgtgccgttcatcaaggcacaacgatgccagacggtttttcaatctggcatcaccttgacgctcatggcattcctttcaaaagtatcacccccaaaaacgacactctgttaattacatttgactccagcgaccagagcgccgccgcaaaagcggtcctcgacagaacattgccccatggctacatcattgcgcagcaggacaataacagtcaggctatgcagtggctgacccggttacgggataactctcatcgcttcggataacttcctgttatccgaaacatatcactcactttggtgatttcaccgtaactgtctatgattaatgaggcggtggttaacactaccgcttcgttgtctggacaatcgttcctttgtaataggtccgaatcacaatggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgccgataagattgccaaacgcgaacggaaactggcagaagcgcaggaagagctgaaaaagctggaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcgaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgcgaaaatccgtggacgggcgtgggcattggcgctgcaatcggtgtagtgctcggcgttctgctgtcgcgtcgttaattatggcggacactcatcacgcacaagggcccggtaaaagcgttctgggcatcgggcagcgaattgtttctatcatggttgaaatggtagagacacgtctgcggctggcggtggtggagctggaagaggaaaaagcgaatctctttcaacttttactgatgctgggcctgacgatgcttttcgctgcatttggtcttatgagcctgatggtgctaattatttgggcggttgacccgcaatatcgcctgaatgcgatgattgccaccaccgtggtgttgctgctactggcactgattggcggtatctggacgctacgtaaatcgcgtaagtctacgttgctgcgccatacacgccatgagttagcaaacgatcggcagctgctcgaggaggagtcccgtgagcagtaaagtcgaacgtgaacgacgtaaggcgcaactgcttagccagatccagcaacaacggctggatctttccgccagtcgtcgtgaatggctggagacaacaggcgcttacgatcgtcgctggaatatgctgctaagtctgcgctcctgggcgctggttggcagtagcgtgatggcgatctggacgattcgccatcctaatatgctggtccgctgggccagacgcggttttggcgtatggagcgcctggcgtctggttaaaacgaccctcaagcagcaacagcttcgcggttaacttccctctggccggagccattccggccttatccctcaaattttttgaagatttttgacagttttccttgctaacaatcatcattcaccacgtttatgattctctccatcgacagcaacgacgctaataccgcgccattgcacaaaaaaacaatcagcagcctgagtggcgcagtggagagtatgatgaaaaaattagaagatgttggtgtactggtagcgcgcattttaatgccgattctgtttattaccgctggctggggaaaaattactggctacgcgggtacccaacaatatatggaagcaatgggcgtcccgggttttatgctgccactggtgattctgcttgagtttggtggtggtctggcaatcctgttcggtttcctgactcgcaccacagccctgtttactgcgggctttacgctgctgacggcatttttatttcacagcaactttgctgaaggcgtcaactcgctgatgttcatgaaaaacctgacaatttctggcggattcctgctgctggcaattaccggtccgggcgcgtatagcatcgaccgcctgctgaataaaaagtggtaagcacgcgctatacttaacgataaaaaacgaggaggaagctcctcgtttttgctattggaggagagaaaaatgggtcaactgattgacggcgtctggcatgacacctggtacgataccaaatctaccggcggtaaatttcaacgttcagcttccgcatttcgtaactggctcactgccgatggcgctcctggccccactggcacaggcggttttatcgcagagaaagatcgttatcatctctatgtttcactcgcctgcccgtgggcgcaccgcacgctgatcatgcgcaaactcaaaggactggaaccgtttatttccgtttccgtagtgaacccgctgatgctggaaaacggttggacctttgatgacagttttccgggagcaaccggagacacgctctatcaaaatgaatttctgtatcagctttatctccacgccgatccacactacagcggacgagttactgttcccgtgctgtgggacaaaaagaaccacaccatcgtcagcaacgaatcagcagaaatcatccgcatgttcaataccgcgtttgatgcgctgggcgcgaaagcgggtgattactaccctccagccctgcaaacaaaaattgacgaacttaacggctggatttatgacaccgttaacaacggcgtgtataaagctggttttgccaccagccaggaagcttacgacgaggcggtggcgaaagtgtttgaatcgctggcacgactggagcagattttaggccagcatcgttacctgaccggcaaccagctaaccgaagccgatattcgcctgtggactacgctggtgcgttttgatccggtgtatgtgacccacttcaagtgtgataagcaccgcatcagcgattacctgaatctgtacggttttctgcgcgatatctaccagatgccggggatcgccgaaacagtcaatttcgatcatatccgtaatcattacttccgcagccataagaccatcaaccctacggggattatttcaattggtccgtggcaggatctcgatgaaccgcatggacgagatgttcgcttcggttaaaaaaaggcaccttacgaggtgcctctgataattagctaagtgcatgttgttcatgtcggatgtggcatgaacgccttatctgacatacaaaacattgtacattcaatagattgcataacccgcgcagaccagataagcgtagcgcatctggcgattttgcgcttgtcatcagtcttagcgcgccttcacggcactttattaattccttgaacgaatatttactgccatttcattcacgtctattcttaatttgctgctttaaaaacaagtgattgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctgctggataaaatgttaggctggcaacgcgctggtggcgaaggcatcctgacgacaatctacggtattctggtgtttttaccgtggtgggcggttcagttccgccgcctgcacgacaccgaccgctcggcgtggtgggcactgctattcttaatcccgtttatcggctggcttattatcatcgtctttaactgccaggcgggtacgccaggcgaaaaccgctttggaccagatccaaaactggaaccttaaaacaaatctgctcgccggatgtctgactcatccggcttttatcattatgttgatgaatgaataatttactaatgtttatttaaaatatttcaatgtcgttatataaattacctataaaaaataaccatgtatttatcttaaatatcaaaacctttataacatccgaaaaagaaagatacgaatagcatttacacaatacccggaatagactttcgtcacttttaattaaagggatgtttttatgcagtggtatttgtccgtattaaaaaattatgttggtttctctggtcgcgcacgtcgtaaagagtactggatgtttactctgattaacgccatcgtcggcgctattatcaatgtcattcaattgattttaggtctggagcttccatatctgtctatgctttatttgctggcaaccttccttcccgtccttgcgcttgctatccgtcgcttacacgataccgaccgttcaggtgcctgggccttgctcttttttgttccgtttattggctggctcgtgcttctggtttttttctgcacagaaggtacttctggcagcaatcgttacggaaacgatccgaagtttggttcaaattaatcttagaattggggcgatatttcgcccctttttattaacaataataaatattattttccgttaaaaagtttgggaatttcccgcagacaccaggatttcgcttcccccatactgtcacgacgccaggccataataatatcgatctcgctggtcgattccgggctgacgacacgcaaccgcccttccgcaatatctttttcgaccataggatacggcatcgtcgccacgccaagccccgccagtaatgcctgacgtttatcttcaatcgtgctcaccgttaagcgcggctgtttgtccagcagctgtacggtcaacaccgggcgctcacgagcggtatccgccaccgcaattccacgatatttcacacgcgtcacttcagataacggttccggctcctgatgaatcgggtgatcaggcgcggcaacgtagacgttcattaacgtatagagcttgcgcgagttgatctccgacgaggaacgaaaatgcatatccggcgcgataacaatatccgcccgcccctgctccagccgttcccacgcccccgccagcacttctgtgatgattgccagttgggtattggcttttgccgccagtttgtcgattaacgggaaaaaggcaggtgtcggtaccagcgcttcggtcacaatggtgagatgcgtttcccaaccgcgcgcgagagcttccgcatcagtagtcagtttatctgcggcttccagcaaaacgcgccctcgctccaacaacatcctcccgacattggtgaatttggtacgatggcccgagcggtcaaacagcaccacatccagctcttcttccagtttttgcatggtgtagctaagtgcggaaggcacgcgtcccagctcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgatagcgaaggcaatcatgttcaggccagcgccggagaggcgttgctgctctctacccagccgggtgtcagctatagcgaacacaatctcagcaaagacaaaccgttaacgcgaatgcagctttggctggacgcctgcccgcagcgagagaatccgctgattcaaaagctggcgcttaatatgggcaagcagcaattaatcgcctcgccagagggtgcgatgggaagcctgcaattacgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctagttgtttttacagggagatgatgatgagtaaaaaattggccaaaaagcgccagccggtgaagcccgtggtggcgaaagaacctgctcgcaccgccaaaaattttggctatgaagagatgttgagcgagctggaagctatcgtcgcggatgctgaaacgcgtttagccgaggatgaagctaccgcgtaaagacaggttgccggatgcggcgaaaacgccttatccggcctacaaaatccaacaacattaacgaattaaacaacccgtaggccggacaagatgcgccagcatcgcatccggcacgatccccaaaacctggcgtttatctggccttgctcgccataatctcgataatctgccgatccgtttgctgcatcgaatggcttgctaacgcacacaggttggcaatcgactgctcaacatcatgcgccacaatcccttcattgccggtcacggcggtatcatccagcgccattaacaccgctttccacgcagccgaagcactggtcgaaaccttcatcgcgcagctgttcgacgcaccatcgcaaatcatgccgctgacatcgccgatcatactgctgatcgccatcgagatggtttcataacgcccatccaccagccatgccatcccggcggcggcccccattgctgcggtcgttgcggcacacagcgcagacaaacgcggtaactggttatggatgtaaattgcgctcaaatgcgaaagcatcagcgcacgcgccagccgttcatcatccgctccgaagtgttctgctaccaccaccacaggcattgttgcggtaatcccctggttacccgagccggagttactcatagccggaagcgtagcgccgcccatacgcgcatcggatgccgcgctggtacgaatcacaatggatgaagagagatctttcgccagcaaaccgcgctcgcactgtttttccagcgtcgcgccaatatgcagcccccacttaccgctcaaaccttcctgcgataacgcacaatttagcttcgcggaatcgagaataaagcggatcgccgcaaacgggacttcattgacgaacttcaggatctcagccagcgtcgttctggaaagcaccgtcagcggagactcttgctcgccctctgccacacacgcctgctgggtaaacaccacaccatcgtgcgtctcgatatgcacaatgttggtatgcccgccgacgatggtgacacacgcccacttctcaccgttccagactttggcgcgtgagaagaggatttcatcgcaaggttcctggatcttaacggagactttccccgccgccagcagtgctttggcatcggcaattgcctgcgctgttgcgtctttcagcacttccagcccggcgttggcatttccacctaacgcccccagcgccgccgcaatcggcagccccaccattcccgtgccgggaacggtgacgcccagaccgttcttcatcagatttggcgaaacccaggcttctacacgttcaaccggaccttccagttctgccgcagcaaccgccgccgccagcgccagtgaaatcggttcagtacatcccagcgccggttttacttcctcctgaacggcgaggatgtaacgctgccataacggatttaaagtcgaatcaaacatattaaaaaccttaaaatttcaggtaaatcaagaaaatgccaggaacggagaaacacacagcaacaaaccagtgacgataatcaggtacagagacatccctttgtatttgtgcaatgctggtactttgtaaaccagccacgccgggatcaggcaccctaccatgccgaaaatcgggctacagatagaggtgaagctcaacaccggtgcgttcagtacgatggcgctccaggccagcaaaatggcgaaaatcatgatgccgcgctgaacgagattttcgttaatcttctcggcaggcatcttgcgacgcaggatgttcattacgatcccttgcgttgcttcgcgaaagcctaaatagacgccaaagaatgcagtcatgacagcaaagatattgagaatgacgctgaccactttcacccacgctgcgccgtcaccgctaataaactgtgcggcaatcgccagcgcggaaatattctgctcataggcttttaccgcttcgtcatgtcccatcgccagcgtgaacgacacggcgtagaaaaagacggtgacaaacaaaatgccaaacgcgatattcattgcccgcaatgctttatgccgcgccacttcaattgatttttcccgcgagcgataagagatcaccatcggacttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccaccagcagcttggtcagcaccatgccggtcgaaattttgaataacaatttctcgccgcgtgaggagatcgccaccagaatgcaaatcagtaccagaccataaaagggactgtctgacagcaacccttccgtcacgccgaaggtatgcaggtaggaagcactatcgttggtgatggcggtggaatagacgaacatccaaatcaccagcattacgaaatagagcgcacctaacaggatgccccagtttttacctaaataaccgctaatgacgctcgggtaatctttacattctggtgattctgccagcgtattaataaacaatcgctgaaacagatacattgccgggtaaccaatcaccgatgagagcaaaaatacccacaatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaatattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaggagaatattcattctctatttgcggcagatcacaaaaaaaaggtgcacatttgtgcacccaaggatgaaagctgacagcaatgtcagccgcagaccactttaatggccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaatagcccccgcggccagaaaatagcgggcaattgaccgctcgtttaccggacgacggaacttatcgtaataagccagtactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagctgacgacgcagcgctacggcacggcgcggcacattgagcggaccaggcagcacgccttcagtgttcatcccacgttcaataccgtcatgcatcacttgccagatacgggcaaaaccggcgtcaatttccgctttgctgcgcagcgctagctcgttgtgcatcatcagaccagatatagacaggccgttgtaatcacacattttcagcagttcacctgctgagtggaaatcgtaaggtacggacgtttcgacatcgtgcgacaggccgaagtgttcttcttcgacaataaacccgccgccgacagagtaataggttttacttaatagctcttcctgtcccttccaggcagtgatccgcattccgttctcatggcgaggcaacatttcgggatggaagataatgttctttgctacaggaaaatcaacaatatgcgcaccagatgccactggcagccgcccgctgcgcgttactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccacggtatgcgaactggagggaccaatcccaattttgaaaatatcgaatgcactaatcatatccacaccctcggattgccgttcagtgaagtggagcggaacgaccttacgaccgtcccgctcacgaggctttacgcactacgtactgcgatggcttcaatttccagcttcacatctttcggcaaacgcgcgacctgcacacagctccgggtcggataggtcgcctgatgctcatcgaagaactgcttatagacttcgttgatggtggcaaaatcattcagatcggtgataaacacggtcatcttgatgatatcgcccacgctcagcccggcagcaaccacgatcgctttgacgttttcgaggcttaaacgcgcctgatcttgcacatcagccgggatctcaccggtctgtgggcaaaccggtatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttgaagcgcacggcgtagccagagacacggattgtcaggttaggatatttttccgggtgctcgatggcatccagcagcatttcccgattcattacgttgacgttgaggtgttgaccgccttcgacatccgcttcgtggtggaaatacccatccagcaggccgacaaggttggttttacgtactggatcttctttgcccagcgccgcaggaacgattgagaaggtgtacgagatcccatctttggcgtaggtgaacggcagtttcgccaccgacgtcaatgaggccacggcacctttgcggtcacgaccatgcatcgggttagcgcccggcgcgaacggtgttccggcgcgacgaccgtccggcgtattaccggttttctggccgtacaccacgttagaagtgatagtcagaatcgactgggtagggacggcgttgcgataggttggcagcgctttaattttcttcataaagcgttcaaccaggtcgcaggcaatgctgtctacgcgctcgtcgttgttgccgtactgcggatattcaccgtcgatttcaaagtccaccgccaggccgttttcgtcacggattggtttcacgcgggcatatttgatggcagacagggagtccgtcgccaccgacaggcccgcgatgccgcatgccatagtgcgatagacatcacgatcgtgcagcgccatcagcgaagcttcgtagctgtacttgtcgtgcatgtagtgaatgatattcagcgcgctgatgtactgcaccgccagccagtccatgaagtgatcgaggctgtccatcactttgtcgtaatccagcacgtcgtccatcagcggtgctgttttcggcccgacctgaatcttcagcttctcgtccaccccgccgttaattgcgtagagcagcgttttcgccaggttagcgcgtgcaccaaagaactgcatttgcttaccaatcaccattgggctgacgcagcaggcaatcgcgtaatcgtcgctgttgaagtcagtacgcatcagatcgtcattttcatactgcaaggaagaggtgacgatcgacacctgcgcggcatattttttgaaggcaatcggtaattcttccgaccaaagaatggtcaggttaggttccggtgccggccccatagtgtgcagggtgtgcaaatagcggaaggagtttttggtcaccagcgtacgaccgtccagccccatcccgccgatcacttccgtcgcccagattgggtcgccggagaacagcgaatcaaattccggtgtacgcaggaagcgtaccatacggatcttcatgatgaagtgatcgatcagttcctgtgcctgctgctcattgagtacgccagctttaaagtcgcgctcaatgtagatatcgaggaacgatgccgtgcggcccagcgacatcgcgccgccattttgcgatttcactgccgccagataagcgaagtagagccactgcaccgcttcctgcgcattctgcgccgggcgagagatatcaaagccatatttcgccgccatttcctgaatctgcaacagcgcatgacgatgctctgccagctcctcacgcagacggatggtggcttccagatcctcgcctttttccagacgagactggagatcggcaaattgcagttcgcgttcacgtaccagataactgatgccatacagcgctacgcggcgatagtcaccgataatgcgcccacggccatagccatctggtaaaccggtcagcacgccagatttacggcagcgcagcatatccggtgagtaaacatcaaatacgccctggttatgggttttacgcagatcggtaaacagatattcaaattcactgtccatttctcggccataggcgtggaatgaacttttaatcatattaatgccaccgaacgggtgtagcgcacgtttcaacggcgcatccgtttgcaggccaacaattttttccagcggctggttaatatatcccgcatcatgagcggtaattgtggtggcaatattggtatcgaaatcaaccggcgcgtgggttgcattttcgatacggatgccttccattactttttcccacaattccgtggtggcaggcgtcgcttcggcgaggaaagattcatcgccttcatacggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttaactttgcctaaatgaatggcatccaaagcaatcattttttcttcgttagtcggaataacggcacaaatgacacgcgcattttcactggaaacaattcgctcaccacaggagttagagcgattattcatttctgtatcaatctctaagcctaatacagccaaatgttccatgaccagacgacgaattaagcttgaattctctcctattccgccggtgaatataattccatccaggcgacgtaatgaagctgcgtgtccggcaatatgacgggcaattcggtgaacaaaggttttaattgccagttgcgcgcgttcgtgaccttcatgccaggctttttccagaacacgtaaatccgaagaaagaccggaaatacctaataatcccgactctttattcactacgcgttccaggtcacccaggctctggttggtttggctggcgacccaggacatcgcaccaaagtcgacatcgccactgcgggtacccatcatcaagccttccagcggcgtcattcccattgaggtatcaacactctgaccgttgcgaaccgcgcagattgacgcgccattgccaagatgcgccacaaccaggccggagtcatcttccgccagattcagcagcgaatgtgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccggaaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaaggccacactgtcatttaaattccgtttttccagttcaaatgcaattgccttcaatgcaccttcgtagctgtggtgagccagcggtgctggctctcccccatttacggataagaatgcattttccgagttaataccgtcggcaatacctgacattaatacttcacagtcgctggcatcgagcacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagggatgcgataatcggtgcgcccatggcttcaatcaggtcaaggatgttcgggttggcgtaggcaacaacccaggtggagcccatgatgaagatcatgctgatagtgttcagtttacccagcgacactttagttttgtcgcctttataaccaaacttcaggaccaggccattcagaccttccagcgttcccagatagtgaccgaagaaagatttgaagatagccacgagtgcgatgatggaagccgcatattccagtgtaatcgcgaacgttgttttggtaccggtcatggacgcaaagtggttagccagataagaaagcactggaatattctgcgctttggcttccgccatgttggccggagacagagtaaacaggcagctaaaggcaaagaacatcaccactgcaaccatcagcatgctggcacgagaaatgatttgggaacatttacgttcggtgaagtcgcgaccgaagtctttctcatactcttcacgcttagaaaccacgaaggaagagacgattggcgagaagttaaaggagaaaaccatgatggaaatccccagccagacagtgatcaggataccgtcatgaccggttaacgacagcgaaccgaggtcaacctggtcgataactgcagagttccagtaagggatcagcgacaaagaaatcagcaccaggctggcgataaacggccataccaggtagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatagtaacgccataaatccacagcagtgggcaaatcgcgaagaagtacaggaacgtgataaccacgccgccagttttaccaaaatgctcttccaccgtttccgtaatgttgccggaagggttagagccagaaagacacagacgcgccagcgcccggtggcaataaaacgcgatggggtatgccaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtggttatttctccggagtggaaagaagccgccatgccgtgaacgttttcagactgtacgccaataacacgaatggtcgggttaatagatttaattgccaccgcaataccagcaattaaaccgccaccaccaattggcacaatcacgttatcgacatcatagagatcttccataatttccagaccaatcgttccctggccagcaatcactttcggatcatcgtaaggtgggataaaaatacggccttccatttcgacaatttcgctcactttagcgatagtgtcgttgaagttatcaccatgcagaacgacttctgcggagtagtcgcacgttgccgctactttggattttggcgcaccttttggcatcaccactttaccgtcgatacccagcatcgcgcaggagagggaaaccccttgcgcatggttgcccgcagaacaggccaccacgcctttgcgtttttccgcatcggtcagtgaacttaatttattaaatgcgccacgaattttaaatgaacccgtacgctgcatattttcaaacttcaggaatatttcacctttgcaacgttcactaaaatagttggagcgaggcatgcctgttttataaattcgcccagccagtcgttgtttcgcttcaataatgtcatcaatagcaaccggcagatcgtatgtaatatgcattataaaacctcttcgcctgaattaaatatgtaggtaaccgtaaccgacacctgcaagacagacaggtggattatttatgtttaaataaaaacaaataactaaccaacttctattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgacgtcatatcacaaggaattacagttaagaaatcagcattgagaacaagattataaattgtcacgactgagtcggttttaacgatgttttcaatactgatgccatttctttgtaacgtagtaagcagttcgctgtagtaccccatattagtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcacttaacgtaccaatcgcaaaatccagtcgaccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaattccacaccaaaataatcttcaatatcgttaatgattttactgacggccggttgagttaaccctaattcttttgcagccgagccgatagaaccacttctaatgacttcctgaaagactaccaggtgctgcgttttcggaagaagaatagtgctcataacgacctacgttaattacctcattgacggcatgaagtgtatcaaaatgaaatgaacaggatatgtgcgaccactcacaaattaactttcaatactttccagagtatcgttattacaattaaatacctttaaatatcaacaagttaaagtataaaaatcagcataaaccctgatttttgtcaaaaaaaatgacggggataaccatattttatggcgataacatcattcgttatgtggttaatacaaaaaaggggctgagaccatatttcaagcaattaccggataattaccaggcaaaatttgagttaaatttaatgagcaagttctcaaattttattataaataaaccattttcagtgataaataatgcggcatgtcacattttttcacgctatttgttggagaacaaacatttattttatcaatattttaaaatttcgaatacatgtattgatcatctcgaacaattgattaacgtcaactttttctcttctgacaggacgtcattttgtgaatgcaatcgttttccataaattcttctcccctcataggcgacgaatagcattttgtgttgaggatcacaaaacgaataattgctgatcgccgcgataaggtcagacaaagacaacaagggaaattttcacagagcttttgatcggcgtaggccacagaatgttgcttcgtttactgtaacgccgggtaaatgagcgttttttgatagtgcgaaagaaccctgcgaggaaaataagcatctattattgtttgtcatgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattgattatttataaaggataaaataatgttccctgtttcatcaattggtaatgatattagtagtgatttagtccgtcgaaaaatgaatgaccttcctgaaagcccaacaggaaataacctcgaagcactagcaccaggtatagaaaaactaaaacagacctctattgaaatggtcactttacttaacacgttacaacctggtggaaaatgcattatcactggtgattttcaaaaagaattagcgtacttacaaaatgtaattctttataatgtctcgtctcttcgtctggattttttaggttataacgcccaaattattcaacgatcggacaatacttgtgaacttaccattaatgaaccgttaaaaaaccaggaaatatccacaggtaatatcaatattaattgcccattaaaagatatttacaatgaaatcaggaggttaaacgtaatttttagttgtgggactggagatatcgttgatctatcctctctggacttacgtaatgtcgatttagattattatgatttcacagataaacatatggctaatactattttaaatccttttaaattgaattcaacaaattttactaatgccaacatgtttcaggttaattttgttagttcaacacaaaacgccacaatctcctgggattatttactaaaaataacgcctgttttaataagcattagcgatatgtattctgaagaaaaaatcaagtttgtcgaaagttgtttaaatgagcctggagacattaccgaagaacaattaaaaattatgagatttgcaattataaaatctataccaagggcaactcttacagataaattagaaaatgaattaacaaaagaaatatataaaagctcatcgaaaatcatcaattgcttgaacagaattaaattaacagagatgaaagaattctcatcagaaaaaatatatgattacatcgatataatcattgaagattatgaaaataccaaagaaaatgcttatctggtcgtcccccaaattaattatactatggatttaaacatagaagactctagctcagaagagttactttcagataataccctcgagaaagacgaaaattctccggacaatggctttgaggtcggggaatataacacatatgaagcatataactcagagaagcaatattttaccagagaggactatacgtatgattacgaccttttaaatgcaatatagacttaataacttcttacaaagtctattattaataccgtagatatttattcatcttaccctgtgcaccaaaagcaaaaactcactgacgcgggtttgaaactgatggcaaccgcaaaaatgcctgatgcgctacgcttatcaggcctacgccatctctgcaatatattgaatttgcgtgcttttgtaggcaggataaggcgttcacgccgcatccggcatgaataaagcgcactcaacaatctgaaacccgccggaacggtttattacgtacatcaggtaaaactgaccgataagccgctttcttttgggtatagtgtcgtggacagtcattcatctttctgcccctccaaaagtaaaaacccgccgaagcgggtttttacgtaaaacaggtgaaactgaccgataagccgctttcttttgggtatagtgtcgtggacagtcattcatctttctgcccctccaaaagcaaaaacccgccgaagcgggtttttacgtaaaccaggtgaaactgaccgataagccgctttcttttgggtatagcgtcgtggacagtcattcatctttctgcccctccaaaagcaaaaacccgccgaagcgggtttttacgtaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttgcgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagccccgcggaatgcttcgtccaacgtacctatgctggtcaatacgctgaagaccgcatcaatgccatgctgatgtacaacgccaacatcatcggtcaggctacccgcaatgccaatcaccggtttatggtacttcttcgccacgtttgcgacaccaatcggtaccttcccgtgaatactctggctgtcaatacgcccttcaccggtgatcaccagcgtacaatcgtgaatatgttcctccagattcagcgccgtagtgacgatttcaataccacttttcagttccgcaccaagaaacgccattagcgccgcgcccataccacccgcagctcctgcaccggggacatctttcacatcaacatgcagcgcttttttaatgacctcggcatagtgagagaggttattgtccagctcaacaatcatcgcttcactggctcccttttgtgggccaaagatgcgcgatgcgccgttatcgcccaccagcggattggtgacatcacaagcgacgcgaatgacgcaatcttttaagcgcggatcgaggccggaaatatcaatatcattcagagtattaagactaccgccgccaaaaccaatttcattgccgttggcgtcgcataatttcgcccccagcgcctgtaccatgcctgcgccgccatcatttgtagcgctgccgccaatgccgataataatgtttgtcgcaccgctctccagcgcctgcaggattaactcgcctgtgccgcgtgaagtggtcacgagtggatcgcgtttttccgcaggtaccagctccagcccactggccgccgccatttcaataaacgcggttttgccatcgccggagatcccccaactggcattcactttctcgcccagcggccctgtaacccaggcgtgacgttcagccccctgggtggctgcaatcatcgcttccaccgttccttcgccaccgtcggcaaccggaacagaaacgtactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattaacgagtaacttcgactttcgccagtttttcgtagtagcacgccagggcgctatgatccgccgttcctaaaccatctgctcgcagtgcctgcatcatctccataaccgcagctgtgagcggcagttgtgcgccgacgccgtgagaagtatccagcgcattcgccagatccttaatatgcagatcaatacggaagcccggcttgaagttgcggtccatcaccatcggcgctttggcatccagcacggtactgcccgccagtccaccgcgaattgcctgataaaccaggtccgggttaacgcccgctttagttgccagcgttaacgcttctgacatcgcggcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggagcatccagcatatcaatgcctttcgctttcagcgcttcgctgatttcacggcttgccagcggtgcgatagaactcatatcgatcaataccgtacctggcttcgcgccttcaataatgccattctcacccagcgccacctctttcacatgaggggagtttggcagcatggttatgatgacgtcgcactgttcagcgatcgctttagccgtagacgctgtttctgcacctgcagcaatcacgtcagcaatagcttctgggttacggtcagcaaccaccagcgagtaacctgctttcagaaggtttttactcattggtttacccataatccccaggccaataaaaccaactttcatagtcatatcaatcatctctcttgttgcggtggtggttattttttaaaggtatcagccagtttctgagtggcagagcggaagacgccgagatcgctgccgacagccacaaacgtcgcgccccattccagataacgacgcgcatcggcttcgaccggcgcgaggataccgctgggtttgccgtgcgcgctggcacggttaaaaatgtgctgaattgctttttgtacatccgggtgtgatgcattgccgagatggcctaatgccgcggccagatcgctggggccgacgaagatgccgtctacgccttcggtagcggcaatggcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgggttgatgccaccgccagctctgcttcctcttttgtttctacaaaaggaatcaggaagttatagaaaccgatatccagaagacgcttaataattaccggctcgttggtcggcactcgcactactggcgcgctggcgctgcctttcaaggccattaactgcggaataaacgtggagatatcgtttggcgcatgttcgccatccagcaccagccagtcaaacccagccaaaccaagaacttcagtgctaatcgggttagagagtgctgaccagcaaccaatttgtacctgtttcgcagccagtgcggctttgaatttattcgggaaaacatcgttattcatcgcttatacctttgcttatttctgcaattccatacgtttaatgtcgccaactacgaagaggtagcagaccatcgccatcagcgctgaacatcccacgaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcaccggccagcccagcgcaccaaatcctttgccaaagaaagccagcgccatcagcatgaccaccagcgtggtgttgttggtgtagttacataagatgatggtggaagccagcaacattcccagcacaatcggtagcttacgtgccagggtcagggataaaccgcgtttgatcagataatccgagaagacacctcccagcacgccgcccgcaaaaccacacagtgctggaatcgaggcgaccagacccactttcagaatcgacatgcctttttcctgcaccagataaatcgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttcagagataaacttcagctcttccgcagacatacgtgggtgatctgtcgggttatgaatcaacttgatccacagcgccgtcagcacaaaaccaatcacccccataacggtaaagacgtgctcccagccccaggcgaaagtcagccagccaagcagcggcgaaaagagcgccagcgagaaatattgcgccgagttaaagatggcggaggcagtaccacgttctttcgtcgggaaccaggcggcgacaattcgggcgttcgccgggaatgatggcgcttccgagaagccgagcataaagcgcataaagaacatggagatccctgcccaggccagcgggaacatatcaacaaagccttgcaggaaggtgaatagcgaccagaaaaagaggctgtaggtgtaaacttttttcgagccaaacttatcaagcagccagccgccggggatttgcatcagcaagtaggcccagccaaaagcggagaagatgtaacccatcgaaaccgcacttaactgcaactcttttgccacttcggtaccagcaatagacagcgttgcacgatcggcgtagttaacggcggtaacaataaaaataatcagtaatattaaatagcgggtatgcacgcctttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttgcgcgctaaagcacagatttgcgctttaccttaccgggcggcactgcaatccctgaaatgattgacattgatcacatttctgcgtttaaactcctgacattcttatttcacccaatgaagtcatttatttttaaatgagaccaggtcctcattttaataacccctggctggagaatattgcacaatggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaagtgattggttacgccgtgcgtgcaatcccacgcggaagctggatcgacgaatcaatggttgtactaccggaagcgccgccgttacacacgctgccactggcaaccaaagtcccggaacccttaccgccgctggaaggatacacctttgagggctatcgcaatgccgatggcagcgtgggcaccaaaaacctgctcggtatcaccaccagcgtccactgtgtggcaggcgtggtggactatgtagtaaaaatcattgaacgcgatctgctaccgaaatacccgaacgtcgatggcgtggtggggctgaatcatttgtacggttgtggcgtggcgattaacgcaccggcggcagttgtacctatccgtaccattcacaatatttcgctgaatcctaactttggcggcgaagtaatggtgattggcctgggttgtgaaaagttgcagcctgagcgcctgctgactggaacggatgatgtgcaagctattccagtagaaagcgccagcattgtcagtttgcaggatgaaaagcatgtcggttttcagtccatggtcgaggatattttgcagatcgccgaacgccatctacaaaaactgaatcaacggcagcgagaaacctgcccggcttcagaactggtcgttggtatgcagtgcggtggcagcgatgcgttttctggtgtaacggcaaacccggcggttggctatgcgtctgatctactggtgcgctgcggcgcaacggtgatgttttcagaagtaacggaagtgcgtgacgcgatccatctgctgacaccacgcgcagtgaacgaagaggtcggcaaacggctgctggaggagatggagtggtacgataactatctcaatatgggaaaaaccgaccgcagcgccaacccttcgccgggcaacaagaaaggcggtctggcaaacgtggtagagaaggcactcggctccattgctaaatcgggtaaaagcgcaattgttgaagtgctgtcgcccggtcaacgcccgactaaacgcggattaatttacgccgcgacgccagccagcgattttgtctgtggcacgcaacaggtggcttcgggtatcacagtgcaagtgtttacgaccggtcgtggtacgccgtacggcctgatggcggtacccgtcattaaaatggcaacccgcaccgagctggcgaaccgctggtttgatttaatggatattaatgcgggcaccatcgctaccggcgaagaaactattgaagaggtgggctggaagttgttccactttattctcgacgtcgccagcgggaagaagaaaaccttctcggatcaatgggggctgcataaccagctggcggtgtttaacccggcaccggtgacctgatttcttttggaacgtccctcgcaaaacatggccttagtgccatgtttttattgtttaaagcccccacgtccattaataatgcatttgcattaccttagttcaagcttataatttgagcagaaaacaggctgtaaaaggacagtgaatcatgcccgctaatgctcgctctcacgctgtactgaccactgaatcaaaggtcacgatacgcggacaaacaactatccccgcgccagtgcgtgaggccttaaaactgaagccaggccaggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcaacattcaacaaggaaagaaacttgtcgctggcatggacgtcaacattgatgatgagattggcgacgacgaataatggattttccacaaagggttaatggttgggcgctatatgctcatccctgttttcaggaaacctacgacgctttagttgccgaagtcgagacattaaagggaaaagatcctgaaaattatcagagaaaagccgccacaaagttattggcggtagtccataaagtgattgaggagcatatcacggtcaatccatcatcaccggcattccgtcatggcaagtcgttaggctctgggaaaaataaagactggtcacgggtaaaatttggtgctggtcgttatcgtctcttctttcgttatagtgaaaaagagaaagtcatcattctgggatggatgaacgatgaaaacactctgcgcacctacggtaaaaaaacagatgcctataccgtattcagcaaaatgttaaaaagaggacatcctcctgccgactgggaaaccctcacccgagaaacagaagaaacccattgatggtgttcacaatgcccgccgaacgcattcgtgttgaccagcgggcatcctttctcactccccgaccagaatcacttcaaccccagcctttcgcagtccttccaggctatccgcaggaatgccttcatcaacaatgatcatgtcgatacgttgagtatcaatgatcttatgtaaactggaacgattgaacttactggaatcggtgaccacgatgatccgttccgcaacttcgcacatccgacggtttaaacgagcttcatcttcattatgtgtgctgacgccgcgctccagatcgatcgcatctacaccaagaaacagcatatcgaagtggtaattttgcagcgattgctcagcctgatcgccgtaaaaagattgcgactgacggcgcaaatgcccgccggtcatcagcagctcaacgccttccgcttccagcaacgcattagccacgttcataccgttggtcatcgcaattacgtcagtgtgcttgcgcatcagacgagcaatctcaaaagtggtggtcccggaatcgaggataacccgatgacctggctgaatcaactcaacggcagctttcgcaacgctgcgtttcatcgcggtgttcagtgcgcttttatcttccactgatggctcgactgacggcgtcgtgctatcgcagatcaacgcgccaccataggcacgcacagcgatcccctgcttttccagaaacgccagatcgttgcggatcgtcacagtagatacgccatacaatgccgacagatcgttaacctgcacactcccttgctgtcgcagacgctgaatgatctgttctcgtcgctcgctggtgccagtcactcgcttctcacctgaagcgtcggtattactcatagtaagtcctttcgtaaaactttcgtttcatttcgttttgcctattaacgcctttctattaagcaaatgcaagcccaccttgcccattgacgcaagctactctcgtttcagtgactttcattatgtttcttttgtgaatcagatcagaaaaccattatctttcgttttatttttatctcaccatgacgcagtatcaactgaaacaaaacgaaagattaatatcgcagtaatctgaactggagaggaaagtgaaacatctgacagaaatggtgagacagcacaaagcgggcaaaacaaatggaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccggccgctcaggcaatggccaatgccgatgatttgattaaaagctacgttgcggcaggattcaaaaaaatccaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagcctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagccggattgatgaacgcttgattcacggtcaggtcggcgttcaatgggtcggatttgcgggggcaaatctggtgctggtagccaacgatgaggttgccgaagatccggtacaacaaaacctgatggaaatggtactggcagaagggatcgccgtacgtttctggacgctgcaaaaagttatcgacaacattcatcgcgccgccgatcgacagaaaatcctgctggtttgtaaaacacccgccgatttcctgacgctggtgaaaggtggcgttccggtgaatcgcattaacgttggcaatatgcactacgccaatggcaaacaacaaatcgccaaaacggtttctgtggatgcgggcgatatcgcagcatttaacgacctgaaaaccgctggggtggaatgcttcgttcagggcgtcccgacagagcctgctgtggacctctttaaattactttgagggattcatcatggaaatcagcctgttgcaggcatttgcgttgggcattatcgcctttatcgctggcctggatatgtttaacggcctaacccatatgcaccgcccggtggtcctcggcccgttggtcgggctggtacttggcgatctgcataccggaattttaaccggcggtacgctggaactggtgtggatggggctggccccgctggcgggcgcacagccgcctaacgtgattatcggtactatcgtcggcacggcgtttgccattactactggcgtgaaacccgatgtcgcagtaggtgtcgccgtacctttcgctgtcgcagtacagatggggattaccttcctgttctcggtgatgtccggcgtgatgtctcgctgcgacctggcaacaaacccgcgccgcatttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagctgggatgccggatggtcgctatacgttatgtggtgaagaagtgcagatgcacggtggcgttgtccgtaccgcgtctggtgggctggcgggcagtacgctgtctgttgatgcggcagtgcgcaatatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctacatgtgcaacaaatctggattcagggtcaattagcttcgttttgatagtttgctcctttattgggccttcacttcccccgtaaggcctttctttttctttcgttttgatctgtgcagcggtgtcggatgcgacgctaacgcgtcttatccgacctacagttggtgaccgcaaggccggataaagcgtttgcgccgcatccagcaatcccttttgcttcctttatcttttctttcaacgatcacaaatttcgttttatttcttttttctccattgaactttcagtttcttttctatagattttaatcaacgaaagacatcaccaagtgaaatgaaacgaaaggcaagtgaaagcgacaacgcccgacgtcaagttcatcagactaaggattgagttatgccagaaaattacacccctgctgccgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacgtcggcatttatcggtgacatcatcgcgccgtggctcgccagccataccggtaaaaacttcagcgccgtaccgaccaccgatctggtcaccaatccgatggactacctgaacccagctcatccgctgctgttgatctccttcggtcgatccggcaacagcccggaaagcgtcgcagccgtggaactggcaaatcaatttgtaccggaatgctatcacctgccgatcacctgcaacgaagcgggcgctctttaccaaaacgcgatcaacagcgataacgcgtttgccctgctgatgcccgcagaaacgcacgatcgcggctttgcgatgaccagcagcattaccaccatgatggccagctgcctcgcggttttcgcacctgagacgatcaacagccaaaccttccgcgacgtggcggatcgttgccaggcgatcctgacctcactgggcgatttcagcgaaggtgtgtttggttacgcaccgtggaaacggatcgtttatctcggtagcggtggcttacagggcgcagcacgcgagtcggcgctgaaagtgctggaactgacggcgggtaaactggcggccttttatgattctccaaccggattccgtcatggaccaaaatcgctggtcgatgacgaaacgctggtggtggtatttgtctccagccacccttacacccgtcagtatgatcttgatctgctggctgaacttcgccgtgacaaccaggcaatgcgtgtaatcgccatcgccgcggaaagcagcgacatcgtcgctgccggtccacatatcatcctgccaccgtcacgtcactttatcgacgttgagcaggcattttgcttcctgatgtacgcccagacgtttgcactgatgcagtcgctgcacatgggcaatacgccggataccccatcagccagtggcaccgttaaccgcgtggtgcaaggcgtaatcattcatccgtggcaggcataagaggatcgcattatgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggaaaaggagataactaaaccttaataaatacatcactacaatatcgcaacaataatatatttaaaaaaattatattattcaactttatggtgaggattacacaatgaccagtccaaatattctcttaacccgtattgataaccgtctggttcacggtcaggttggcgtgacctggacatccaccatcggtgcaaatctgctggtagtcgtggatgatgttgtcgctaacgatgatattcaacagaaattaatgggtattaccgcggaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggacttacgttttattaaacaacgtggcgtgaatgttttcattcaggacgtccctggcgatcaaaaagaacaaatccctgactaaatctaaaatcgccttaatattggtttgaggtaataaaaatgcatgaaataaccctacttcagggattatccctggcggcgttagtttttgttctggggattgatttttggctggaagccttatttttattccgcccgataatcgtttgtaccctaactggcgctattctcggtgatattcagactggcttaattaccggtggtctgacagagttggctttcgccggattaacccctgcaggtggtgttcagccgcccaacccgattatggcgggtctgatgaccaccgtcattgcatggtctacgggcgttgatgccaaaacagcaattggtcttggcctgccgtttagtttgttaatgcagtacgtcattctgttcttctattccgctttctcattatttatgaccaaagccgataaatgcgcgaaagaggcggatacggcagcgttttcccggcttaactggacaacgatgctcatcgtcgcttcagcgtatgcggtgattgctttcctctgtacttacctggcacagggggcgatgcaggcgctggtgaaagcgatgcccgcctggctgacccacggctttgaagtggctggcggtattctgcctgccgttggttttggcttgctgctgcgcgtaatgttcaaagcgcaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcgctgctgcaagcgagctttaactacgaaaggatgcaggcgggcggttttacctgggcgatgttgccgatcctgaaaaagatttataaggacgacaaaccgggcttaagcgcggcgatgaaagataacctcgaatttattaatacccacccgaatctggtcggattcctgatggggttattaatttcgatggaagaaaaaggagaaaaccgcgacaccattaaaggcctcaaagtggcactgtttggcccaatcgccgggattggcgatgcgattttctggtttactttgttgccgattatggcgggaatttgctcatcatttgccagccagggaaacctgctggggccgattctatttttcgccgtttacctgcttatctttttcctgcgcgtcggctggacccacgtcggttattcagtcggcgtgaaggcgatcgataaagtgcgagagaactcgcagatgattgcccgttcggcaaccatcctcgggatcacggtaatcggcgggctgatcgcttcgtatgtgcatattaacgtggtgacatcgtttgccatcgacaatacccacagcgttgcgctgcagcaggatttcttcgataaagtcttcccgaacattttaccgatggcctacaccctgctgatgtattacttcctgcgggtgaaaaaagcgcatccggtgctgttaatcggcgtgacttttgtgctctctattgtttgttccgcattcggcattttgtaaatggaacgaggcactgcgtctggtggtgcctctttacttaaggaatttcatcctgtgcaaacccttcagcaagttgaaaactatacggcgttaagtgaacgtgccagcgaatatttattggccgtgatccgtagcaaaccgaatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgccaggcacctgcgaaactttcctgcaacagcatatcgtgcagccgctggggctacgtgaagaccagctcatcagctttcgctccgaagagataaatgagacagagtgcgaacgggtaacgaacctgattgcgcgcaaaggcggtctggatttatgcgttctcggattggggaaaaacggtcatcttgggctgaacgaaccgggagaaagcctgcaaccggcctgccatatcagtcaacttgatgccagaacacagcaacatgagatgttaaaaaccgcgggtcgccccgtgactcgtgggatcaccttaggcctgaaggatattctcaatgcccgcgaagttttgttactggtgactggcgaaggaaagcaggatgcgacagatcgttttctcacggctaaagtctctaccgctatcccggcttcatttttatggctgcacagtaactttatttgtttaattaacacctaaccagatgaaaaatttgctcaaaatgtttaaattaacttatgtaacagtcacgcattatattaaataacatttgactgggttgaacataacgccgatagcaaaaggagttatgttcaacaatttaattttagatatacatataacttgttctattaataaatcacctcgtattctgactcgccccctggcgcagcaaagtcaggcatttatactcttttgaatacatagaaaattgatatcaatataatgaaaatatcaaatatttgcatataaatataatcttaaagttcagtctatttaatgttcaatgaaatatttctgcctgtataatctttaaagatgttgaacatatattcacattaaatatgattatgtacttgttacaaggataaggttatatatgaataaagttacaaaaacagctattgcgggcttacttgcgcttttcgcaggtaatgccgctgcaaccgatggtgaaatagtttttgatggcgagattttaaaatccgcttgtgaaatcaatgactctgataagaaaattgaagttgctcttggtcactataatgccgaacagtttcgtaatattggcgagcgtagcccaaaaattccattcactattcctttagttaactgcccaatgactgggtgggagcacgataacggcaacgttgaagcgtctttccgtctatggctggaaacgcgagataatggcaccgtccctaacttccctaatctggcaaaagtaggctcttttgctggcatagcggcaacaggtgtgggtatccgtattgacgatgcggaaagcggaaacattatgccactgaatgctatgggcaatgataacacggtttatcagatcccggcggaatccaatggtattgtcaatgttgacctcatcgcttactacgtatcaaccgtagttccatcagaaatcaccccaggggaagcagacgctatcgttaacgtaacgctggattaccgttaatacgttagggcgttatctgacctgtcagataacgcccttttccttcctctttctcgttgtatcaggttgaaaaataactatgtcaaaacgaacattcgcggtgatattaaccttgttgtgtagcttctgtattggccaggcgcttgcaggaggaatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctggcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacacggatcaaaatgttttatcgccccgcacacctgaagggacgggtaaacgatgcgtggaaatcactggaatttaaacgtagtgaccattcactcaatatatataacccaactgaatattacgtcgtatttgccggactggcagtcgataaaaccgatctcacaagcaaaattgaatatatcgcgcccggagaacataaacagttaccacttcctgcatctggcggaaagaacgtgaaatgggctgcgatcaatgattatggcggcagttccgggacagaaactcgtccactgcaataaaaaatataaaaacacaggtcatcagggaatgccacaacgacaccaccagggacataaacgcacaccgaaacagttggcgctcatcatcaaacgttgtttgccgatggtgctcactggcagcggcatgctttgcactaccgctaacgccgaagagtattatttcgaccccattatgctggaaaccacaaaaagtggtatgcaaacaaccgatctgtcgcgtttttcaaaaaaatatgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcaacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcgttgaagtctcagttgcttctgggagaaagcgccaccagcggcagtattttttccagctacacctttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgtcagcgggtgcctttgaaattaacgatctctacccctcttccaacagcggcgatttagaagtcacgattgaagaaagtgacggtacacaacgtcgctttatccagccttattcttcattacccatgatgcagcgacctgggcatctaaagtatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttaatgaagccaatacccgcaattgggactataacagtcgccaaaaaagtgaaattcaattcaacatcagccagacaatatttgatggggtaagtctgtatgcctccggttcgcagcaagactattggggcaataacgataaaaacaggaatatctctgttggggtttccggccagcaatggggagttggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagcctggaacaaagtctggatgacgataacaaccataacagtagcctgaacgccagttaccgttcaccttatggcaccttcagtgccggatacagctacggtaatgacagcagccaatacaattacggcgttaccggcggcgtggttatccatcctcatggcgtgacgctctcgcaatatctgggcaacgcttttgcgcttatcgatgctaacggagcatctggcgtgaggatacaaaactatccggggattgctaccgatccttttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgctttcagtacaccggattcagaacctacaacctctgtattacaaggcacagcgcagtgccattaaggataaaaaaatgaaaagagcgcctcttataacaggtcttttgttgatatccacatcctgcgcttatgcctcctcaggagggtgtggagccgacagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccacattacaggcaaacgacattccaggactcacaaccgaccaggttgtctctgttaacacccgattcacacagataaaaaacaacacggtatattctgctgcaacccaaacgggtgtttgccagggtgatacgtctcgttatggacccgttaatattggtgcgaacaccacctttaccctgtatgtcaccaagccatttctcggctcgatgaccattccgaaaacggatattgccgtcattaaaggcgcgtgggtcgatggaatgggaagcccgtctacaggtgacttccatgatttagtcaagttatcgattcagggaaatctcaccgccccacagtcgtgcaaaattaatcagggcgatgttattaaggttaattttggattcatcaatggtcagaagtttaccacccgcaatgccatgccagacggttttactccagtagactttgatatcacttatgactgtggtgatacttcaaagattaaaaactcgttgcaaatgcgcatcgacggtacaactggggtagtagaccagtacaacctggtcgccaggcgaagaagttcagacaatgtgcccgatgtcggtattcgtattgaaaatctcggcggcggagttgcaaatattccttttcagaacggtatccttcccgttgatccttccgggcatggcaccgtcaatatgcgcgcctggccagttaatctggtcggtggtgagctggaaacaggaaaatttcagggcacagccaccattaccgtcatcgtgcggtaaaagaagacgttgcgttttgattaacgcaacgcttcggcactgttacccctgctgctccagcgcatacttatacagcgcatttttcttcacgccgtgaatttctgcggccagcgccgccgcttttttcagcggcagttctgcctgtagcagcgccagcgtgcgcagggcatcggcgggtaagtcttcttcctgtgctttatgaccttcgacaatcagcaccatttcgcctttgcgacggttttcatcttcctttacccacgccagcagctcgccaacgggcgcgccgtgaatggtttcccaggttttggtcagctcacgcgccagaaccacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcgtaacagaaacggtcagagggtaaacccgctgcgcttaacgcagtgatagcagcacacggcccgggtagcggcaccacgcggatccccgcttcacggcaggtacgcaccagatggtagccaggatcgttaattagcggcgttccggcatcggaaaccagcgcaatgttttgcccctcttgcagcttcgccagcagcgtttcagctttttgttgttcgttatggtcgtgcagcgcaaacaaccgggcattaatcccaaaatgttgcagcaataaaccggtgtgacgagtatcctcggcggcaatcagatcaacggcctgtaatacctctaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttatcttcagcagatgcagcaaagctctgatgataccaggatcaactggcaattactcgccattcgtgcactggtgaaagaaggtaaaaccgggcaggcggttgagttgtttaaccaactaccgcaagaactgaacgatgctcagcgtcgcgagaaaacactgctggcggtagagattaaactggcgcagaaagattttgctggcgcgcaaaacttgctggcgaaaatcacacctgccgatttagaacaaaaccagcaagcgcgttactggcaggcaaaaatcgatgccagccaggggcgtccttccattgatttactgcgcgcgttaattgctcaggaaccgctgcttggcgcgaaagaaaaacagcagaatattgatgccacctggcaggcgctctcctccatgactcaggaacaggcgaatacgctggtgatcaacgccgacgaaaatattctgcaaggctggctggatctgcagcgcgtctggtttgataaccgtaacgatcccgacatgatgaaagccgggatcgccgactggcagaaacgttatccgaacaatccgggcgcgaaaatgctgccaacgcagttggttaacgtaaaagcgtttaaaccagcctcgaccaacaaaatcgccctgctgttgccactgaatggccaggcagcggtatttggtcgcactattcagcaaggctttgaagcggcgaaaaatatcggcactcagccagtggcagctcaggtagctgccgcacctgccgcagacgtagctgaacaacctcagccgcaaaccgtggatggcgttgccagcccggcacaagcctcggttagcgatctgaccggtgaacagcctgcagcccagccggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtactggcactgaaccagccggagaatatcgaaaatcgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgaattacgcgcgggtgttaacggcggttctggtattgctttaacgggtagcccgattactctcagagcgacaaccgactccggcatgacgaccaacaatccaacgctgcaaaccacgccaaccgatgaccagttcaccaataatggcggtcgtgtcgatgcggtgtacattgtggcaacgccgggtgaaatcgcttttatcaaaccgatgatcgccatgcgtaacggtagccagagcggtgcaacgctgtacgccagctcccgcagtgcgcaagggaccgctggcccggatttccgactggagatggaaggcttgcagtacagcgaaatcccgatgctggcaggcggtaatctaccgttaatgcagcaggcactcagcgcggtgaataacgattattcactggctcgcatgtatgcgatgggcgtcgatgcctggtcgctggcaaatcatttctcacaaatgcgccaggttcagggttttgaaatcaacggtaataccggaagcctgacggctaacccggattgcgtgattaacaggaacttatcatggctacagtaccaacaaggtcaggtagtccccgtcagttaaccaccaaacagaccggcgatgcgtgggaagcacaagcgcgtcgctggctggaaggcaaaggactgcggtttatcgccgctaacgtgaacgagcgtggcggcgagatcgatctgataatgcgtgaaggccggaccaccatttttgtcgaggtacgctatcgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcgattgccaacgatcgcttacatgatgaagtgtatgcaaaacaggtgcgggcgctgggtcatgcgggagatgtattgttagccatttccacccgtggcaacagccgcgatattgttaaagcagttgaagccgccgttacgcgtgatatgaccattgtggcattgaccggctatgacggcggcgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgattaaggagaatacatgaaggcattatcgccaatcgcagtccttatttccgcgctgctgttgcaaggttgtgttgccgctgccgtagtgggtaccgctgctgtgggtaccaaagccgcaactgacccacgcagtgtcggcacccaggtggacgatggtaccctggaagtgcgcgtgaacagcgcattgtcgaaagacgaacagattaagaaagaagcgcgcattaatgtaacggcctatcagggcaaagtgctgctggttgggcagtcaccaaatgctgaactttcggctcgcgccaaacagattgctatgggcgtagacggtgccaacgaagtgtataacgagattcgtcagggccagccgattggtctgggcgaagcatctaacgatacgtggatcaccaccaaagtgcgttcgcagctcttaaccagcgacctggtgaaatcgtccaacgtgaaagtgaccaccgaaaacggtgaagtgttcctgatggggctggtgactgaacgtgaagcgaaagcggcggcagatattgccagccgggtgagcggcgtgaagcgggtaactacggcgtttacgtttattaaatagcagccccttgtaatgcctgatgcgacgcttgccgcgtcttatcaggcctacaacgatacaaaccgtaggtcagataaggcgtttacgccgcatccgacatgttttccctcaaatcagaacaacagcgccagcccgccgacaatcacaccagacactgccaccatcgcccctgtcagccataaggctttcgccgggaacgctttgcgcagcataatcagtgacggcaaactcactgccgggagcgtcatcaacaatgccagcgccggagcggttcccatacctgccagcatcatcgtttgtacaatcggaatttctgctgccgtgggaatgacaaacaagcatcctgctaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaacccgccctgtgcttccggtatgtcaatttcgaccggtgcctgcgtttgcggtgtttcacgcacccatttttgcaccagcgtcgcaatcagcaacaccatcaccagcccggccaccagacgaatcgccgcaaaaccccagccgaggacaaagcccataaacaccagcgtcgccgggtttaacaccggattgcccatccagaatgccagcgcaccgcccatcgacacctgttggcgacgcattcccgccgcgaccggagccgcacagcaggtacacatcatgcccggcaacgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgaggaaatagatcatcgcgtaatccaacgccgcctgccatgggttagcatccgcctgcgcaaggatagatttaccgatactgtgggtttcggcagcagtaaacgctttgccgtagtaaggttcccatttcacataccagagaccggcaatgacaacgagaaagaaaagcgcgggtttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacgccttcatgctcaggccgcatcgactctgccagcatgacccgcgccacgtctctcgcatcaatggatttccagttacctggtaacaaacggaacagcggcgcaaaaagcgtttcgttcatccgctgtttgctacgatcgcccagtaacatcgacgggcgagcaatggtcaatttcggccagttctgggcgattaatgcttcttccatctcccctttgacgcggttatagaaaaacggcgagtgggcattggcacccatcgcactgactaccaacatatgctgcgcgcccagtcgccgcccggttaatgcggtatccactaccagcgtgtaatcggcatgaataaacgcctctttgctccccgcttctcgccgcgtggtgccgagacaacaaaacacaatgtcgatgggatcggtgacctgcgccaacgcgtcactcagttgcggatcatggggattaaacaccccgggcatatcgcccaacggacgtcgcgtcggcgcagcaatggcgttaactttcggttcgttaatcaacatccgcagcaggtgaccgcccaccagccccgttgcgcctgtaatcagtacctgactcatcttcgctcctttacagaattgtctgccttgcgctccacggctcatgcaccaggcttaatagaccatgaggtaattatccccgattgtgggaaattcgcctcatccaatgcaacaacgcggaggaagcatgagtaagaaaattgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtgaccatcgataaatccatcgatgaagtgacgcctgcggagtttgatgccctgctgctaccgggcggccattcaccggattatctgcgtggggacaaccgttttgtcacctttacccgtgattttgtgaatagtggcaaaccggtgtttgccatctgtcacggcccgcagttgctgatcagcgccgatgtgattcgggggcgcaaactgaccgcagttaaaccgatcattattgatgttaaaaatgcgggcgcggaattttacgatcaggaagtcgtggttgataaagatcagctggttaccagccggacaccggacgatctgccagcgtttaaccgcgaggcgttacgcctgctcggtgcctgagtcgcgtagccaaatcatttttttaccaaagcccagcgtgttgtcggtgaatttgatttcatcgagccggatttcccacaccggggccgacagcattctggcaaccggaaagcgacgattgtacgccttgcgcgcgaggtcgctttcctcaccttccagcctgcggatctcacctttaaactgcacaccgcgaattaacgctaccgttttcggctgaccgtttaccgttccggcaaccgcagcctgcggcccactcatctgcgcgtggcgcgttttttcttccgtcaaaatgtagaaggcgactttctgcgcatcaaaaagataaaaggcattagcgcaccagagttccccttcctgctgcacacaccaagtgacaacatgttgttttgccagccaacggctgatggcgatgagtgtttccattgctgttctcttttatactgtgggcctgaccttaacatgcgacgcagacgatgacaccctggtttctttacttgatccgtaccgccgacaataagctttataccgggatcaccacggatgtcgaacgccgctatcagcagcaccaaagcggcaaaggggcgaaagcactgcgcgggaaaggagaactaacgctggtgttttccgcgccagtgggcgatcgttcgctggcgttacgggcggaatatcgcgttaagcaactgaccaaacggcaaaaagagcgtctggtagcggaaggcgcagggtttgcagagctgttaagcagtctgcaaaccccggagattaaaagcgattgaaatgctcgtgatactcaaccaggccggtaacgccattcagcgcgtcatccgctaaacgatgtacctggaaggcgctttcagtgcccggccagcggcaacgcagatcgtgatgcgccgccagttcaaagccgaaacgactgtacagcgccggatcgcccagcgtcaccactgcggcatagccgaactcattaagcgaatcgagtccttcatagaccagttggcgtgccagcccctgtccacggtatttttcatcaaccgccaacggtgccatgccgacccattgcaggtcttcgccctgcacatcaaccggactaaatgccacatagccaatgacctgaccttcgtcatctgtcgccaccagccccagcgtcagaaagccatcttcacgcagatcgtgaaccagcttcgcttccgcatcactttcgaatgagcgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcaccagccgacgctggaagaagagcgtatccggatcttgtttacgcgccgcaatcatcagcagatcgctggcgtcggcactaaaactcacatcagcttgcgcgttctggctaacgaccagtttgccattcaccaccgaggtaaaccattgcaggtcaatatcacgcacatgaatacttaaccagcggccttcaagaaactccagctcgccatcatccagcgcctggcggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcagctgggtgccgacgcgctgatcctcgccgacctcgccatgctggagtacgccgccgagcgttatccgcatattgagcgccacgtatcggtgcaggcttcggcgaccaatgaagaggcgattaacttttatcatcgccattttgacgttgctcgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatctgacgggtgagtcgcccaacaccataggcgcgtgttctccggcccgtttcgtgcgctggcaacaaacgccgcaggggctggaatcccgcctgaacgaagtgctgatcgaccgttatcaggacggcgaaaacgcaggttatccgacgctatgtaaagggcgttatctggtggacggcgagcgctatcacgcgctggaagaaccaaccagtctcaataccctggaactgctgccggagttaatggcggcgaatattgcttcggtgaaaattgaaggccgccagcgtagcccggcgtatgtcagccaggtggcgaaagtctggcgtcaggctatcgaccgttgtaaggccgatccgcaaaactttgtaccgcaaagcgcgtggatggagacgctcgggtcgatgtccgaaggcacgcaaaccactcttggcgcatatcaccgtaaatggcagtgagaaaagcaatgaaatattccttagggccagtgctgtggtactggccaaaagagacgctggaagaattttatcagcaggccgccaccagcagcgccgacgtgatttatcttggtgaagcggtatgcagcaagcgtcgggcaaccaaagttggcgactggctggagatggcaaaatcgctcgccgggagtggtaagcagattgtgctctccacgctggcgctggtgcaggcatcatctgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacactgaaaatattgctcaaacagggcatgatgcgctggtgtatgccagtggagctttcccgcgactggctggtgaatctgcttaatcagtgcgatgagctgggcattcgtaaccagtttgaagtggaagtcctgagctacggtcatctgccgctggcctactccgcccgctgctttaccgcgcgttcggaagaccgcccgaaagatgagtgtgaaacctgctgcattaagtatccgaacgggcgcaacgtgctgtcgcaggaaaaccaacaagtgtttgtactcaatggcattcagaccatgagcggctacgtttacaacctcggtaacgagctggcatccatgcagggcctggttgatgtggtccgcctgtcaccgcagggtactgacactttcgcgatgctcgacgccttccgcgctaatgaaaatggcgctgcaccactgccgttgacggcgaacagcgactgtaacggctactggcggcggctggcaggactggagctgcaagcctaagtaaatagctcactttgttaacaactttaactactctttaatgcagtattaaagattaatcggtaacaaagtgagctgttatgactgataaaaccattgcgttttcgctactcgatctggcccccattcccgaaggttcttcagcgcgagaagcattctcccactctctcgatctcgcccgtctggctgaaaagcgcggctatcatcgctactggctggcagaacaccacaatatgactggcattgccagtgctgccacgtcggtattgatcggctatctggcggcgaataccaccacgctgcatctggggtctggcggcgtgatgttgcctaaccactcaccgttggtcattgcagaacagttcggcacgcttaatacactctatccggggcgaatcgatttggggctgggtcgtgctccgggtagtgaccaacggacaatgatggcgctacgtcgtcatatgagcggcgatattgataatttcccccgcgatgtggcggagctggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgctgttccaggcgctgcatctttatcgcagcaacttcaaaccgtcagcacggctggaaaaaccatacgcgatggtgtgcatcaatattatcgccgccgacagcaaccgcgacgctgaatttctgtttacctcaatgcagcaagcctttgtgaagctgcgccgtggcgaaaccgggcaactgccgccgccgattcaaaatatggatcagttctggtcaccgtctgagcagtatggcgtgcagcaggcgctgagtatgtcgttggtaggtgataaagcgaaagtgcgtcatggcttgcagtcgatcctgcgcgaaaccgacgccgatgagattatggtcaacgggcagattttcgaccaccaggcgcggctgcattcgtttgagctggcgatggatgttaaggaagagttgttgggatagtgtgtcttaacgcgggaagccttatccgagctggcaacgctgtcctacatagacctgataagcgaagcgcatcaggcattgtgtaggcagcagaaatgtcggataaggcaccgctgattactgatacaccggcagtaaattaaagctcgataaaatatgcaccagtgcgttgccgacgccaaacaccagaatcagcgcaatcatcggcttgccaccccagacgcggaatttcgggctgccaaagcgtttacgcgatgcacgggctaacagcgccggaacaattgccgcccagatggtagccgctaaaccagcataaccaatggcgtacaggaatccgttcgggaacaacagcccccccacaactggcggggcaaaggtcagcaatgccgttttcaagcggcccacagccgagtcgtcgaaaccaaacagatctgccagatagtcaaacaaacccagcgttacgccgaggaacgaactcgctaccgcaaagtttgagaacacgaccagcagcagatccagactacggctgttcagtacgccgcttaacgcctgtaccagcacatcaatattaccgcccttctctgcaataccgataaactccggacgcgggatgttacccatcgtcgccagcaaccagatggtatacagcgccagcgccatcagcgtaccgtacaccagacatttcacgatggttttcggatctttgccgtaatacttcatcaggcttggcacgttaccgtgataaccaaacgatgccagacagaacggcagggtcatcaacagatacggtgcataagacgcattgctttcggcgacgttgaacaatgtcgcaggctgcacatgccccagcaggctaccaaaggtgaggaagaaggtaatgactttcgcccccagcacaatcgctgtcatgcgactgacggctttagtgctcaaccacaccacaaacgctaccagcaatgcaaaaccaaaacccgccgcccgtgccgggacgtttagtgacatctctgcgaaggtgtgatgcagaatcgaaccactggcagaaatataggcataggtcaggatatagagcacaaaggcaatggaaatgccgttgaccacgttccagcctttgcccagcaaatctttggtgatggtgtcaaaactcgaaccgattctgtaattcaggttagcttccagaatcatcaagccggaatgcagcatacagaaccaggtaaagatcagcgccgccattgaccagaaaaaccacgccccggacatgaccactggcagagaaaacatccctgcgccaataatggtgccgccgataatcaccacgccgccaagcagcgacggtgacgtttgggtggtggttagtgttgccatgagggcttctctccagtgaaaaatagtgcgactgcgttgttatgcattgcactgtaccagtacacgagtacaaaagacagaaaaaaagccccgatggtaaaaatcggggctgtatatattattttacagattgtgttcgctgttcagcgatgattacgcatcaccaccgaaacgacgacgaccggtagaatcatcacgacgcggagcgcggccttcacgacgttcgccgctaaaacgacgaccatcaccacggccaccttcacggcgttcaccgctgaagttacgaccgccttcacgacgttcgccaccgaaaccacgaccaccgccacgacgctcaccgccagtatgcggctgtgcatcgcccagtaactgcatgttcatcggcttgttgagaatgcgagtgcgcgtaaagtgttgcagcacttcacccggcatacctttcggcagttcgatggtggagtgagaagcaaacagcttgatgttaccaatgtaacggctgctgatgtcgccttcgttagcaatcgcaccaacgatatgacgaacttcaacaccatcatcgcggcccacttcaatgcggtacagctgcatatcgccaacatcacgacgttcacgacgcggacgatcttcacggtcaccacgcgggccacggtcgttacgatcgcgcggaccacggtcatcacggtcacggaattcacgtttcggacgcatcggcgcatctggcggtacgatcagagtacgttcaccctgtgccattttcagcagtgccgcagccagagtttcgagatccagctcttcaccttcagcagtcggctgaattttgctcagcagtgcgcggtattgatccagatcgctgctttccagctgctgctgtactttagcggcgaatttttccagacggcgtttgcctagcagttctgcgttcggcagttctacttccggaatagtcagcttcatagtacgttcaatgttgcgcagcagacgacgctcgcggttctcaacgaacagcagcgcgcggccagcacgacccgcacgaccggtacgaccgatacggtgaacgtaagactcagaatccatcgggatatcgtagttaactaccaggctgatacgctcaacgtccaggccacgggctgcaacgtcggtcgcaatcaggatgtccagacgaccatctttcaggcgttccagtgtctgttcacgcagcgcctggttcatgtcaccgttcagcgcggcgctgttgtagccgttacgctcaagagcttcagccacttccagagtcgcgtttttggtacgaacgaagataatcgccgcatcaaaatcttccgcttccaggaaacgtaccagtgcttcgtttttgcgcataccccagacagtccagtagctctggctgatgtcaggacgggtagtcacgctggactgaatgcgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcagtttagagaggtccagagtgccacgtttcaggtggtccagcagacggcccggagtaccgacaacgatctgcggcccctgacgcagggcgcgtaattgcacgtcataacgctggccgccgtacagagcaaccacatttacgccgcgcatgtgtttagagaaatccgtcattgcttcagcaacctgtaccgccagttcgcgggtcggtgccagcaccagaatctgtggtgctttcagctcaggatcaagattctgcaacagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatttgttccatacgtgccagaatcacttcctgctgtaaagtcggttgcaatggtaccgcgaggacttcacttttacgccaggaagtattactgcatcctgcaagcgtaagtgctgtcgcaacgaaacaccagcgcaaaaaaggcttcatttcccactcccgaagaccacggttgaatgaacgtcctgttcccggttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagaactttcaccggtacttcctgacccatctgcaggtaatcggtcactttctcaacgcgtttgtcagcgatttgagagatgtggaccagaccttctttaccgccgccgatggcaacaaatgcgccaaagtcaacgatacgggtcactttaccagtgtagacgcggcccacttcgatttctgcagtgatctcttcgatacgacgaatagcatgtttcgctttctcgccgtcggtcgctgcaatcttcacagtaccgtcatcttcgatttcgatggtggtgccagtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacgcccaggatatgcagacgcgcacctttagcctggttcagcgcaacctgcatgatctctttggtgataccttcaattttgatatccatctgcagtgcagagataccgtcgcgggaacctgcaactttgaagtccatatcgcccaggtgatcttcgtcgcccaaaatgtcagacagtacaacgtagttgtcgccttctttcaccagacccattgcgatacccgcaacggcagctttgatcggcacacctgcgtccatcagcgccagagacgcgccgcacacggaagccatagaagaggaaccgttggattcagtgatttcagacacaacacgtacggtgtacgggaatttgtccatatccggcatgactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacgccagtacgcacatccagaccacggatcatatctttttcacgaccgtcgatacgcggttcgcctgccagtacgcggctacgaacaacgtttttctcgatcgcgtgcagaatttcacccagttcgttttcgtccagggtttcgtcttcagcaagcagcgtcgcgatggtttcagatttgatgacatcaacctgcgcataacgctcttgtttgtcggtgatgcggtaagcatcgctcaggcgagcttcagccagtgcagcaacgcgcgcgtttagcgcttcgtttaccggctccggctgccagtcccaacgcggtttaccggcttctttcaccagttcattgatgttctgaataacaacctgctgttgttcatgaccgaacactactgcgcccagcatctggtcttcgctcagcagttgagcttcagattcaaccatcagtacagcggcttcagtaccggcaacaaccagatccagtttgctctctttcagctcgtcctgagtcgggttcagtacgtactggtcattgatgtaacctacgcgggcagcaccaatcgggccattgaacggaataccagacagagacagcgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagtgggaagaagtcctgacctggtttggcttttttctggccaacaacggtaacgaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggcactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaatttgccgttctcaccttccgtgacgcgaaccagtccttccagtggcgcaccagatgtacgaaccgggttaccatttttgaagtaaacagaagacgttaacggaagattcaccaccggatagtccgaagctggactgtccattggcatcagtaatggatcaagtaactccgcggctggaatatcctgctgttcagcttgctcaacaagttcacgcaggtgctccagggtcaccatccgttcaaccggatatttacttaccgccagacggcgcaggtaaataacatgcgcgccacagccgagtttttcacccaggtcatcaatgatggtgcggatataagtgccttttgagcagtgaatttccagctccagctcattgccttcatggcgaataaacagcaattcataaacggtaatcggacgcgcttcacgcggaacttcaatgccctgacgcgcatattcgtacagttttttgccctgatatttcagtgctgaatacatcgaagggatctgttcgatatcgccacggaaagtatccagtgccgctgccagctgctctgcgctaaaggttaccggacgttcttcaacgatctgtccgtcggcatcagaagtatcggtacgctgtccaagacgcgcaatgacccgatagcgtttgtcggagtccagcagatactgggaaaacttcgtcgcttccccgaggcaaatcggcaacatgccggtcgccagcgggtccagcgcaccggtatgcccggcacggttggcgttatatatacgtttcactttttgcagcgcatcgttgctggacataccctgaggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcttgcaacgctttgatgcccgctttaaccgcgtcttcatctttgtcgttgaggaacgtcacatatactttggcatacgccaggtcgcgagacatttcgacaccggaaacggtggtcatcatgcccaggcgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttgacctgataagacgcgccagcgtcacatcaggcaatccatgccggatgcagcgtaaacgccttatcccgcatggaaccctaaaaaccttaagcaatggtacgttggatctcgatgatttcgaatacttcgatcacatcgccagtgcggacgtcgttgtagttcttaacgccgataccacattccataccgttacggacttcgttaacgtcatctttgaagcggcgcagggactccagctcgccttcgtagataaccacgttgtcacgcagaacgcggatcgggttgtgacgtttaaccacaccttcggtaaccatacagcctgcgatggcaccaaatttcggcgatttgaacacgtcacgaacttccgccagaccgataatctgctgtttcagttccggagacagcataccgctcatcgccgctttcacttcgtcaatcaggttatagatgacggagtagtaacgcagatccaggctttccgcttcaatcactttacgtgcagaggcatcagcacgtacgttaaagccaaccaggatggcgttggacgccgcagccagggtggcgtcggtttcggtgataccacctacgccagaaccgatgatcttcactttaacttcgtcagtagacagtttcagcaaggagtcggagatcgcttcgacagaaccctgtacgtctgccttcaggacgatattcacttcgtgaacttcgccttcggtcatgttggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccgaggatttccaccggaatggacggacccgcttccagcacttcctgacccagttcgttacgcatcgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcgtccagcagttcatcgataccggtacccgctttcgcagatacgtgtacgaactggctttcaccgccccactcttccggcaggatgccgtactgggagagttcgttcttaacgcgatccggatcagcttctggtttatcgatcttgttcactgcaaccaccaccggtacctgcgccgctttcgcgtgctggattgcttcgatggtctgcggcatcacaccgtcgtcggcagcaacaaccaggactacgatgtccgttgcctgcgcaccacgagcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttatggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatagtttcgccgatcacaacgtcacggttaacggcctgagcaggcttctggaagccttgctgcagcgaagaacctttacgttttccgcctttaccgccacgtactgctgcgcgtgcttcttcacgatcagcttttgattcagcgtgtttgttgcctttcttcggacgcgctgctttcgcgttacgaccacggccacggccgccttcgacttcacgatcgctttcgtcttctgcctggcgagcatgttgagaagtagtgacgtgataatcgctggaatcttcagtcggttccgcgttatcagtccatttgttttcttccgccatacgacgtgcttcttcagcaacgcgacgtgcttcttcttcgagtttacgacgcgcttcttcttcagctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcttgttctgcggcctcacgttcagctttttgttgcgcctcgcgtttagccgattcttctgcctcacgacgggcttgctcttccgcttcacgctgcgcttgctcttccgctgcaaggcgttcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcggccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccaattcttccagcgtcgagaagccttcttctaccagaacagtcgcgaagtcttcgtcgatgtcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgccggtgccattgcgttaatcacgaactgcgccgggttatcatcccacaggacgatatcgatacgctcgccacccagttcagtagacaccgcctgaacacgcgcgccacgcatacctacgcaagcacctaccggatcgatacgtttatcgttggttttcaccgcgattttcgcacgagaacccggatcgcgagccgctgctttaatttcaatcacttcttcgccgatttctggcacttcaatacggaacagttcgatcagcatttccggcttggaacgagtgacgaacagttgcgcgccacgcgcttccgggcgaacggaatagagcacgccacgaacgcggtcgccagggcggaagttttcacgcggcagcatatcttcgcgcaggatcacggcttcagcgttgttgcccagatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaagtgtcaaaatcaccgcttttgcgatcgatctgtacgcggacgtcgatctcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatgggatcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaaggactctaagggaaagtggttgcgggggccggatttgaaccgacgatcttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcatgtgaatgaatatccagttcactttcatttgttgaatacttttgccttctcctgctctcccttaagcgcattattttacaaaaaacacactaaactcttcctgtctccgataaaagatgattaaatgaaaactcatttattttgcataaaaattcagtgagagcggaaatccaggctcatcatcagttaattaagcagggtgttattttatgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaattcgacatcaaccctgcccttcaggggtggggttaccttgcttatcctctgtaaactcctttctgagcatcacataatcgaaaacatcatggtttgcatccacaacccgtgagtctcctttatagtgtgcaatcacttcctcaagcgtttgcggctgttccggctttgttacccccatccacgcattaataaggtaattattgtaagctgtcgaaaagatgttgttttccgttgtgcgatccacgccatccccaagaacggggctataccagataaacatcgggacatgatatgcctgctggctagcctccctgcctccatgaaaatagacgttcttcttcgtagggtcacgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacggcgctggattgcggataggcgctacaagccggttcatggcttccatttaaatgaagaacaatcagtttcttttgctgcgtattttgctgtaatgcttgcgataaatgcggcaacaacaattcatcaaatcctctgacataaactgtttccatggcgcgcatggcgatactggtaactgctgtaccattctgccgaaaagcggattgcgagcttagccagaaagtctgaaatcctgcttgattagccatattaataatgttgtcggggtaattatgaatgtcatgactcaaaacagaatcagcagttaaagaaaggggaaccgacagcgcagtgtaaggtgcgccgcttattgcttgattaaacagtttgatctgttttctttgtgcttcaacttgcggtgtcgtagagcgtgtatatccatacaaagacatattgtcgacacgtacagactcccccacaatcaacacgtaggtatcaatacctgtatccctgactgataattgaaaatacggcaccgtgtttgcaattgagagtaatctttgatgctctttcgctgctaaagcaaaatagttgagattgaaaaacggcgtataggtagcaaatcgcgacgctagtatatatggactgaacgcttttttattttttgcatctttataagcaaattgacaagcggaaaataaactgcccgaaatgacaatcagcaataatattcctgtcactttttttgtcggcaaggaaacatcatattttattattactgccaaaaaaagaagggataaaaaagcaaaggcacatagataagggatatacatccccagcattttgacaacttcatccggatcactctggagcacactaatcgcaaatccatcattgaaagttgtaccaaaggtacaccatgaatagaggctaatactcatgtctgccgcagtcagtaacacaaatggtgcggcaacaagcaggcgaagcggaagggatgatatacgttttacaaccaggatggtcagaacgaagaacagcaagcgctgaaccatatgcgctccggaagaagcgactaagttcgtaataccaaaaacaataacacaaagatacaacaaccaatgagatttaaaagttctagcaaatttgttgaatactgtcatccagaaatccaagttcacaaccaatataaacaattatcaacaatgtttaattttatatcagacatgtttttcaactctgatccatatcagaacgaaacactgttagttttttctttttaaatgatgcggccattgcgttctcagtaattaaataacattatcaatgcgtctctaaacattacgcagaacgtagccatcagtcgttatactgacaggagcaggatggtttatcgagaagtaaacatatccgtattcgtaccggaactggagttgacacaataaagtgccaattatgtcagtagaagggaaaaatttataactaaggcgtaccggcaccatcgtttcaaggtaccagctacgagtaaagcaactggacgagatacagatacctgacaaccattcctcagaccaggaccaaaacgaaaaaagacgcttttcagcgtctcttttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggctgagtttgttcggttttcgccggtgcactcagattttcccattcgctacctttattggttttgttgctattgatgttacccagcaccagactgatgatgaagaataacgttgccagcagcgccgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcatacataatcaacctgttccttgcggagttgccgcgtaccaatgcttcaaccaataaagcgggagtttttaatctttcccactgaagcgggtgtgaatactaaccaaagcgaatgaccttcgcaagggcaattttatcgcattgtatcaactgcggaaaaaaacagcaaaaccgatgtgttcgctgagaaaaaaggcgacaatcgccgcctttttagccagttatctaacgctttaaacggcttttactgcatcggcgatgcggtgtgcaaattcagtcacctgcgcttcgtcttcgccttccaccatcacgcgaattaacggttcggtgccggatttacgcagcaacacgcgtccacggttgcccagcgcagcttcaacctctgcggtcacggctttaactgactcatgctcaagtggatcgccgctacctgcggtgtaacgtacgttaaccagaatctgcgggaacattttcatgccgctgcaaaggtcgtgcaggctcatatggttacgtgccatcgccgccagcacctgcaagccagcaacgatgccgtcaccggtagtagttttatccagcaggatcacatgaccggaattctctgcaccgatacgccagcctttctcctgcattttttccagtacgtagcggtcacccactttcgcgcgcgcaaatggaattcctaactgtttcagcgccagttcaagccccatgttgctcatcaatgtacccacagcgccaccacgcagctggccctgacgaagaccttcacgcgcgatgatatacatgatctgatcgccatcgactttattgccttcatggtcaaccataatcacgcgatcgccatcgccgtcgaaggcaataccgagatccgctttttcagccagcacacgagcctggagcgcgcgaacgtcggtagcccccacttcggcattgatgtttacaccgtttggctcacaaccgatagcgataacgttcgcccccagttcgcgcagcacgttcggcgcgatgtgataagtcgcaccgtttgcacaatccaccacaatcttcagttcactgaggctaagttcgttcgggaacgtggctttgcaaaactcgatatagcgacccgcggcatcaacgatacggctggctttacccagttctgccgaatcaacgcagctgatctccttttccatttccgcttcgatggcctcttctaccgcatccggcagtttggtgccgtcgatagagaagaatttaatgccattatcgtagaacgggttatgcgatgcagatatcacaattccggcctctgcgcggaaggtacgcgtcagataagccacggccggtgttggcatcgggccagtgaagagtgcggaaaggcccgctgccgccagacccgcttccagtgctgactccagcatatagccagaaatacgcgtgtctttaccaataataatcttacgggagccgtggcgcgccagcactttacccgcggcccaacccagcttaagcacaaaatcaggtgtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaatgatgtgcgcgccttgcattgcggcaatgaccgcacaggccagactaccgctcaggcgctcggacggccccacgttcagcagctgcccaatcatcgattttcgtgacatacccaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaagtagcgattcacttctgcaaagacatcgtcatacttcggagcttcctgcatggtttttggatttccctgcatatgcatcagacaaaccggtaaaccggtttctgcagccgcctccagagcgccaggttcggaaagggagcggatatcattaataatgtgagcgccaactttcgctgactcacggatgacttctggtttggatgtatcgactgagatccagacttcgaagcgttgagcaattgcctcaaccacaggaataacacgttgcaactcttcttcaacgctaacttccgccgcccctgggcgcgtggactcgccaccaacgtcaatgatcgtcgcgccagcgttgatcatcagattcgcatgtttcaccgcatctatcagcgagttatgcgtgccaccatccgaaaaggaatcaggcgtgacgttgaggatccccattacgtgaggatggctaaggtccagtgaagtaccctgggcaaagagtttcatgatgttatccctggtatgaattgataagaaaaaaccccggagcacgccccggggttttcggtacaaatacagtcatctgatgcgggaacttacttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtggacccaatttctcagagaagccccactgagtcaccatgttacgtgccaggttggtcgcaactttaatatcgttggacgcaccggtagatacatgttccggcccgtagatgatctcttctgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataatcgcatgacccgcttcgtggtaagccgtcgattctttctgcgcttccgtcatcaccatggagcgacgttccgcacccatcatgattttgtctttcgctttctcgaactcaaccatcgacacaacgcgtttgttgccacgagcagcgaacagtgccgcttcgttcaccaggttcgccaggtcagcaccggagaaaccaggagtaccacgggcaatgattgccgcgtcgatatcgggtgccaatggtacgcgacgcatgtgaactttcaggatctgctcacgaccgcgaacatctggcaagccgaccacaacctgacggtcgaaacggccaggacgcagcagggccgggtcgagaacgtccggacggttagtcgcggcgataacgatgataccttcgttaccttcgaagccatccatctcaaccagcatctggttcagagtctgttcacgttcatcgtgaccaccgcccagaccagcgccacgctggcggcctacggcgtcgatttcatcgataaagatgatgcacggtgccgctttcttcgcctgttcgaacatgtcacgaacacgggatgcacccacaccgacgaacatttctacgaagtcagaaccggagatagtaaagaacggaactttcgcttcgcctgcaatcgctttcgccagcagcgttttaccggtacccggaggaccgaccatcaagacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttccgtcagcatgcgcgctttgctcttaccaaacgacatggcacctttgccaccgccgccctgcatttgacgcatgaagaagatccagacaccaatcagcaacagcatcgggaaccaggagatgaagatagaagccagcaggcttggttcttcaggcggttcaccgacaaccttgacgttcttggtcaacaggttatccagtaatttcggatcctgaaccggaatgtaagtggtataacggttactatctttcttggtaacgttgatttcacgtccgttgatacgcgcttcacgaacctggtcgttattgacctcttgtaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacatttgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatccagattcagcaccgttacggtagcaccaaaaataacgcgcccattgttgggcattttggtgacatcaatcacctgcgcgttcgacagcttggcttcgatgtctttaatacggccttcgcagaaaccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatagggcaagtcttcacccaccccggctgttcggcctgcccggcataactccttaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcctgccagtacccagaaagtgattactgcgctggcggcgttgattcaactcggccccgattttcgttttaccacgacgcttgaaaccaaaggcaatgtggaaaacggcgtacttaagggtgacttagtggcgcgatttggtgccgatccgacgttaaaacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgccccaaagcctggtgatatggcttttatacgcgtggcatcttattaccccgttacgatgttcagccaggtacgcaccctcccccgtggttctgccgaagcgcaatactgcgaactggatgtggtgccaggcgacctgaaccgctttacgctgacgggatgcctgccacaacgttctgagccgctcccgttggcttttgccgtgcaggatggagccagctatgccggtgcaattctgaaagatgagttaaaacaggcgggtatcacctggagcggaacactgctgcgccagactcaggttaacgaacctggaacggtagttgccagtaaacagtcggccccgctgcacgatctgcttaagattatgctgaaaaagtcggacaacatgatcgccgatacggttttccgcatgataggccatgcgcgcttcaatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaacctgcggatcagcgtaatcgccgtattccgttagtgcgttttgaaagccgtttgtataaagatatttatcagaacaattagtcaaaaagaaaccccggcacatggccggggcttcagattattgacaaagtgcgctttgtttatgccggatgcggcgtaaacgccttatccggcctacaaaatcgtgcaaattcaacatattgcaattctcttgtaggcctgataagcgtagcgcatcaggctgatttggcgtttatcatcagtgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccactcgccgcagagatcagataatatttatcttcccagcccagcgcctcagcgatcgctttcgctttctcttcggcttctaccttatccagcagatcgatcttgttgaacactaaccaacgcggtttcgtcgccagatcctggctgtatttttccagctcgctgataataatacgcgcgttttcaaccggatcggtgccgtcaatcggatcgatatcgatgaggtgcaacaggacgcggcaacgttccaggtgcttcaggaagcgaatgcccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcacgaataaaggtcgatttacccgcgtttggcatccccaacataccgacgtcagccagcagcatcagctccagcagcagctcgcgcttatcgcccggcgtgccgttggttttctgccgcggtgtacggttaacggacgatttgaaacgggtattgcccagaccgtgccagccgcccttagcaaccagcagacgctgaccgtgtttggtcatatcgcccatggtttcaccagtaccctggtcgattacacgcgtacctaccggcactttaatcgtcacgtctttaccgcgcttaccggtacagtcgcggcttgcgccattctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaaggtattcagtccgcaaaaaattaaacatgcgagctgccagtggctaagctgcgctatcactccaggctttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccgctcaggagcatcaatgcccctacaacctgagtgctgcgcattttctctttgaggataaatacgctggcaaccatcatgccaactggcgagagttgcccaatcacctgcgaagcggtcggactcaggtattgcaaggatgagctgaacaggatgaagttcccaaacagcccggcggtcgccactgccaacaaaatcaaccagcgtggcttacgaaacacgcgtaatggcggcaacctcttcttcaccgcaagaatggcacccaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacgtcgcaccatgcgcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaatcccctcccctcatcccgcgcagcgcgcgggatggttccagtaagttccataaaaacacttattcagctctataacacctgaaaaatagggatgtgcatctttatatattctgaatattcacactctttacaggaactttttagagcaataggccatcaggagtatagtgatgctcgacagaagaagtgttctgaatgaaagcgactaacttaaggagtgaggaaaaatggaaagtaatttcattgactggcatcccgctgacatcattgcgggtttgcgcaagaagggaacgtcaatggcggcggaatctcgcagaaatggtttgagttcctcaacgctggcgaatgcattatcgcgcccatggccgaaaggagagatgattattgcgaaagccctgggaactgacccctgggttatctggccatcacgctaccatgatccgcagacccatgagtttatcgacagaacgcagttgatgcgtagctacactaaaccgaaaaaatgagtggtctggcggtagccccgcgaacggggctgccagctctcagacgattattcgcctttcacacgctcaatatttgcacctaaagcgcgcagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgataaacccggtcccttctgccaccaggttcaacagcgtgaactgggcctgcatatcggtcgggaatgccggatgcggcgcggtacgtacgttaacagccttcggacgtttgccatgcatatccaggctaatccagtcttcgccgacttcgatgtccgctccagcgtcacgcagtttcgccagcacggcgtcgagagtatctggctgcgcgttacggcagataattttgccgcgagaaatcgccgccgccaccaggaaagtaccggtttcgatacgatccggcagaacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgccagggttgcagcacacatgatggtcaccgttgcgccaacgctgactttatccatcacgatatgtgcacctttcaaacgaccatcgacggaagctttaacgtaaccttcttccagtttgatggtcgcgcctaattgttcgaggccagaaatgtgtagatcaaccggacgcgcaccgatcgtacaaccgccaggtagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtctttcagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcggaccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaaccagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccccccgtatccacgcgggagacacggctaagatcgatgcaggtaatccccttcaccgcttcctcacgcatttcccaaagcggtagcaaaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccaattgcccgtctgggagtttttacgccactggaagtccagacgcaccggcggacggccattcgggtcaataatggtaacgcgaataggcacaatggttttatcgcccagcggctgttctggcgcaatctgataggtttgaccgtgatacatcgccagcgcctgaccgtaagcctgcttcaggtactcacggaaagcggcaaagtaggcttcacgttgagcaggggtcgcactcttgtaatactggcccagcaccagcgcaccggcgtatttcacctgtacgtatggcagcagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagaggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttagtgtcctgaattgtatcgccatccttcaggatagcagtccccagttccgggtcttcaaaaccgacgtttaatgccagatattgttcccccagcaggccggaagtacgaatgctcagcgaactggtatctggaatgtggttataacgttgttcaatttccagcgttacgcgcggcagataggttttcgggtccagcgtaatatccgccacccgacccacaacaacgccaccaatactgaccggagagcgcgctttcaggccgccaatgttatcgaacgtcgcataaagcgtgtaggtcggttcagtacgtatggacgtcacgttcgccgccttcaggcaaacaaacagcgccgccagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgaccagatccatacgccagtcgacggcattttgcattgccgaccagaagaacccgctatcaatgcctttccaactgacgccgaccagagatccgccccagatccccacggcgacgaaaataaccgtcaacagtggtaatgaaataaccccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggcgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagtacgcccatggtgatgggatcttgcccaacaaaaggttcatcaaacatgatgagatccggctccagcgcaatcgcacgcgccagcgctgcacgccgcgccatcccaccggaaagttcagaaggcattagtttagccgctccacgcagccccacggcctccagcttcatcatcaccgtactatgcaacaatggcgcgggaagttgggtatgttcgcgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacccgccgtggttagcgaaagctggcatttgttttactttttagccgcataaagtcaaaattaagcatccgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgctgatcatcggcatgacggtggtcagtattggtacatcgttaccagaagtcatcgtctcgcttgccgcgtctctgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgacggcggattgcccgtcgcgtttttatggctcggcattgcgcttatcatcatgccagtggccacgcggatggtggttgataacgccacggtgctggcgaattactttgccatcagcgagttgacgatgggtctgacggcaattgctatcggaaccagcctgccggaactggcaaccgcaatagcgggggttcgcaaaggtgaaaacgacattgctgtcggaaatatcattggcgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatgggaaaatcggggcatattgggcgaaaaatggcggcaacgtttgccagcaccggtacaccttcatttttcgtccatcctggtgaagccgcgcatggtgatttaggcatggttaccccacaggatgtggtgattgctatctctaactctggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcaccaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcgttgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgtgtgcgccctggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatagcaaaagcagagaacattcgtctgctgatcctcgatgtcgatggcgtactgtcagatggcctgatttatatgggcaataatggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgcgaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaacgcacttgtgccagactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggtaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcccagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaacaaccgttctggtgccgtcgcagctgcaggacaaaaacaacaaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgtaggcattgtgccgcgcgatgcgggcaacatcattattgatgatgacgatatcagtctgctgcctctgcatgcacgcgcgcgccgcggtatcggctatctgccacaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagtaatccgctgcttgagcaaatcgacactcatgaagaaatcgacacccgcgaaacgcaagacagtgaaacgctggacaccgccgacgcgctcgaacaaaaagagatgccggaagagctgccgctcgatgccagttgggacaccatttacaccgctggtacaccatccggcaccagcggtgactacattgacgacgagctgccggtctaccagggcgaaacgacgcagaccttgcaggattacctgatgtggcaggttgagctgacaccgttttccgacactgaccgcgctattgctacctctatcgtcgatgccgttgatgaaaccggttatctgactgtcccgctggaagatattctcgaaagtataggcgatgaagagatcgacatcgacgaagttgaagccgtccttaagcggatccaacggtttgatccggtcggtgtggcggcaaaagatctgcgtgactgtctgctgatccaactctcccaattcgataagaccacgccgtggctggaagaggccagactgatcattagcgatcatctcgatctgttagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtctgcaaatcaaccagcactacgcctcgatgtgcaataacgcgcgcaacgatggtgacagccagtttatccgcagcaatctgcaggatgccaaatggttgatcaagagtctggaaagccgtaacgatacgctactgcgcgtgagtcgctgtatcgttgaacagcagcaagccttctttgagcaaggtgaagaatatatgaaaccgatggtactggccgatatcgcccaggctgtcgaaatgcatgaatcgacgatatctcgcgtgaccacgcaaaaatacctgcatagtccacgaggcatttttgaactgaagtatttcttttccagtcacgtcaataccgagggcggcggcgaagcttcctccacggcgattcgtgcgctggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacaactcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggtctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcggcgaaacaacttagcctgccgcctcaggtggtttttgaagctatcctgacgcgggaaaaaatgggcagtaccggtatcggcaatggtattgccattccgcatggcaaactggaagaagatactctgcgcgccgttggcgttttcgttcagctcgaaacgcctatagctttcgatgccatcgacaaccaaccggtggacttactttttgccctgctggtgccggcagaccaaactaaaacgcacctgcatactctgtcgctggtggcgaaacgtctggcggacaaaaccatctgccgccgtttacgcgcagcccagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaaccctggccgatcgcgagatttctgccgccgtcagcattgatgttcgtaatatgccggagtcaccagaaatattcgaacaggcgatgagtaacctgcctgacgctttctcaccgcaactcctgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggctgaaatgctgcgtacccgtctgctgggtaaacgtgaacgcgaactgaccatggtctttgagtctttcggcttcaaacacggtatccctatcgatgcagattacgtctttgacgtgcgcttcttgccgaacccgcactgggatccgaaactgcgtccaatgacaggtcttgataaacctgtcgccgcgttcctcgaccgccacacagaagtacacaattttatctaccagacgcgaagctatcttgagctatggttacctatgctggaaaccaacaaccgtagctacttgacggtcgccattggttgtaccggcgggaagcaccgttcggtgtatattgcagagcaactggcagactacttccgctcgcgcggtaaaaacgtccagtcacgccatcgtacgctggaaaaacgtaaaccatgaccgtcaagcaaactgttgaaatcacaaacaagctgggcatgcatgcccggcctgcaatgaagctgtttgaattaatgcagggttttgacgctgaagtgctcttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaattctggttttgatgaagattaatcttcatcactttgacatacaactcccttcaaactccccccgacaataagaaaatcacgtactgaaatcgttctcaatcaacgtcatttgtacattttgtgcgcttttcactttcagaagaaccttaagaaaaccttaagaggcattgtttaggttttgtttaagttaatcgaccatactggagatcgtcagaaaatatttccaggagatggcatgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgcagattttgacggcaagccttccattacgctgaccgaatttgctgaacaatgccgttacgaagaagacattgcacaactgcgccagctactgaaacagctgaagcgttatttgcaggataaccgtatcgtgacgatgtcgctgaagccgcagaatatcctctgtcaccgcatcagtgagtcagaggttatcccggtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatccagctggtgttgttgcataaacggctcaccgcctaactgatacatctgccgtaaaatccacgcctgacggctacgcacgtagcccgatggcgaggagactttgaaacgaagtggattaggtaatacagctgccagtaatgcagcttccgaccgggtaagtttgctcgcgggtttgtggaaataacgttgtgccgcagcttcgacgccaaacacaccgtcgccaaattcggcgatattcaggtaaaccgtcaggatacgctttttgctccagaccgtttctatccccagcgttaatccggcttccagcccttttcgaacccagctacgcccatcccataaaaagagatttttggctgtctgttgagaaatcgttgaagcaccgcgaatacggttttcattgcgctcgttgtgcgccagggctttctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacctgtcgctcgaccattaccgctgagaagggaacaggcgcaacgctaaacaacgcgatgcccccgccccagaaaacggcgaggacaaccattaaccgcaaaagaaaacggcgaacgaaactaaacaccgttaagcggcttttactcattcagccagaaccagcacgcgggaaaccagcttatcaatgccgctcgccgcttctgcaatgttctgcgccagcatatatgctggggtggtgacaatcttattgtcttcatcaaccacgatatcatcgacaggacacggcacatgctccgcgcccatctcttccagcacttctgcggtatcgatatcagtaccgatggtcaaacgcagcgggaaatcgaaaattttcggcagcatcgccggggcaatacacataaaaccaagcggttttccggcctgatgcatcgcttgtgccagcgcctttaattcacggtcaacggtgcattcgctaccaagactggcaaaattgcttaaattcttcgccgcgccaaacccccccggcacaatcaacgcatccagttcagcggcatcggcctgggccagaggacggatttcaccgcgcgttattcgtgccgcttcaatcagcacattgcgcgtttccgtcatcgcttcgccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcatcctttcgcaattgactgaaacacattaatttttttaataaaaatggtacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagcacttctacgtcgtgacgccactcttctttcatctcttcaatccattcaccgacgttatcttcccaggccggaaggtcaggagactgaatttgctgacccagctgttgcagatggcgtaaccccactgaccccgccgcacctttaattttatgtccttcctcaacaatgccttttttatcctgcgccgtcagattcgactccagcacgctgacatagcccggcatcatcttctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgtttcgtcagttcacgagagatatccagcccggtcatatctggcaactgaatatccagcaacaccaggtcgtattcgcccggtttaaacatctccagcgccgccttgccggtcatggcgacatcaacgctgttacctaatttttccagcacagaacgcgcaacaatcacgttcagttcaatgtcttccaccagcagcacattcagcgccggtaaaggcatatcgtcttcatcaaacgcatcatcgacctcttctgctaccgacggtgcgtggatcgtcaacgtaaaggttgaacctttgccctgttcgctggtaaccgtaatatcgccgcccatatttttcgccagacgacgagaaacggccagaccaataccggtgccggtggcaggtttaccgccatgactgtctttcacctggtaatacatggcgaaaattttatccagctcatcctgcggaatgccgataccagagtcttccacttcaaaatgcagcatatcgccttcatcgtagcgcacgcgcacggtaacctggccttgctgggtgaatttgacggcgttactgatgaggttccacaggatctgccgtaaacgcgtcccgtcggtaatgacctgatgcggtaatggcagcgtcggctccaggttaaagcgcaatcctttttgttgcgcctgcaatgcggagagattttccagatcggcaaggaagctggtgaaatcaaccggttgattatcaagctggaccttgcgccgttccatcttatccatgtcgataatatcgttaaagatattccccagcgtgacggccgaaacatggatggtcttgagatatttttcctgctcggcggtgagttcggtatccagcagaatgcggctcagaccgacgataccgttcagcggtgtacgcaattcgtgactgatggtggagataaacgtcgttttgtcgcggctggcccgttcaagcgcatcctgataccgcttacgctcggtaatgtcgcgaccaaagcccatcaaaccgtgacgtttacccacgcggtcgtagtacggcactttacggatttcaaagcaggctttgcgcccgtccgggtaatccagccactgttcataggtcagtgacacattatgacggaacactttttcatcggtttcaatgacttttgcggcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcatcaaggaaggaacgtaagaatgaggattgctgctcgagctgaatttgtgtctcttcgcgctctttgatttcaattttcagttggccgaaggtttcctgcagttctgcttccgctttttcacgaacggcaatttcctgatttagctgggcaatattatcttttaactgaacgttgaggctcaaatcgcgctcgcgcatctcctccagtttttgcaccagccgtgacagacgttgtcgtgactcctccagttgctcgacgaccaccgatagaaagtagaccgcccacggcgtaatcagcaaaccaaagaagatagaacgaataacatcaatgctttcgacctgaccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaacgacctactccgttggaggtagccacggacgtcccagcgccgatccctgtacgccatgttcattcagatagcgatccagctcgaccattcccgtccatcgattttcgcaccacagcggagcaagcagcgtcgggcgacgggcgctggcggaaatgcggtggtagatcacttccggtggcgtatggcgaatcatttctccggcagtgagcgtgtaatcctccagttcaataccgttcaaacgccccgcttcccaggctttcgccataatgctgcctttcacaatatgcagcggatgcagctttatgccgtccacgccggtttcaaccactcgctccagcgtttgcaaacattcagcctgcccttcgccaggcaggccgacaattaagtgggaacacaccttcagcccgcgctgacgtgccagctgggttgtacgctgataacaggcaaaatcatggccgcggttgatgcgatgcagtgttttgtcgtgggcggtttgtagccccagctccagccacacttcgtaaccctggtccttatattcgcaaagcagatccagcaccgcatccggcacgcagtccgggcgggtacccacacacaaaccgacaatattggcctggctcaccgcctgctgatacatagaacgcagcacctgaacttccgcaaaggtgctggtatacgcctgaaagtaggccagatagcgtttagcgcggttaactaaattcgcctggtgcgccagttgctcggcaatggaacgatgctgctgcgcttcatcggcaaacgaggcaacattacagaatgtgcagccaccacgcccgatggtaccgtcacggttagggcagctaaaaccgccgtgcagcgtcagcttatgcaccttttgcccataacgacgggtgagatcaccaccaaacatattgactaatttctgtaactgcataatctgatagaccgcgccttgaaaagaggccaaagcctgccatttttagctcaattcggcgatgacctggatcaatcgtcccggcctgcttttatcaactgcataatcaatcaaaattaccgaaatttcatgcataatcacataaatcacttttgcttatcttgtgtcagatttttttatctcctgatggattttaggcaaaaacagtagcatgaaacgtcattaccaattaaggcagtataaaatgctggttttgtcgtcagttcaaggcaggataagggttaacacacctttatgacagtcaggaattgactgtttctctaacgacttcccttttagccttaaagataaaatccattttaatttcagtcatttaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctctttctgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggcgacggttgcggcttgctgttacaaaaaccggatcgcttttttcgcatcgttgcgcaggagcgcggctggcgtttagcaaaaaactacgctgtcgggatgctcttcctgaataaagatcctgaactcgccgctgccgcacgccgcatcgttgaagaagaactgcaacgcgaaaccttgtcgattgtgggctggcgtgatgtccccactaacgaaggcgtgctgggtgaaatcgccctctcctctctgccacgcattgagcaaatttttgtgaacgccccggcaggctggcgtccacgcgatatggagcgccgtctgtttatcgcccgccgccgcattgaaaagcgtctcgaagccgacaaagacttctacgtctgtagcctgtcgaatctggtgaacatctataaaggtctgtgtatgccgacggatctgccgcgcttttatctggatcttgcggacctgcgtctggaatcggccatttgcctgttccaccagcgcttctccactaacaccgtaccgcgctggccgctggcgcaaccgttccgctatctggcgcataacggtgaaatcaacaccatcaccggtaaccgccaatgggcgcgtgcgcgtacttataaattccagacaccgcttatccctgacctgcacgacgccgcaccgttcgtcaacgaaaccggctctgactccagttcgatggataacatgctggaactgctgctggcaggcgggatggatatcatccgcgccatgcgtctattagtaccacccgcctggcagaacaacccggatatggacccggaactgcgtgccttctttgactttaactccatgcatatggagccgtgggatggcccggcgggcatcgtgatgtccgacggtcgttttgccgcctgtaacctcgaccgtaacggtctgcgtccggcgcgctacgtcatcaccaaagataagctcatcacctgcgcctctgaagtcggtatctgggattaccagcctgacgaagtggtcgaaaaaggccgcgtcgggccaggcgaactgatggttatcgacacccgcagtgggcgtattctgcactcggcagaaaccgatgacgatctgaaaagccgccatccatataaagagtggatggagaaaaacgtccgccgactggtaccgtttgaagatctgcccgatgaagaagtgggtagccgcgaactggacgacgacacgcttgccagctaccagaaacagtttaactacagcgcggaagagctggactccgtaattcgcgtactgggcgaaaacggtcaggaagcggtcggttcgatgggcgatgataccccattcgccgtgctctccagtcagccgcgcattatttacgactacttccgccagcagtttgcccaggtgactaacccgccaatcgacccgctgcgtgaagcgcatgttatgtcgctcgccaccagtatcggtcgtgaaatgaacgtcttttgcgaagcagagggccaggcgcaccgtttaagctttaaatcgccgattctgctctactccgatttcaaacagctcacgacgatgaaagaggagcactaccgcgcagatacgctggatatcacctttgacgtcactaaaaccacgctcgaagcgacagtcaaagagctgtgcgacaaagccgaaaaaatggtacgtagcggcaccgtgctgctggtgctctccgaccggaatatcgctaaagatcgcctgccggttccagccccgatggcggttggcgcgatccagacccgtctggtcgatcaaagcctgcgttgcgatgccaacatcatcgtcgaaaccgccagcgcccgcgatccgcaccacttcgccgtgttgctgggcttcggcgcgacggctatttatccataccttgcctatgaaacgctgggccgcctggtagacacccatgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctacacgatgatgtagtgggcctgtgcttccagggggcggtcagccgcattggtggagcaagctttgaagacttccagcaggatctgctgaatctgtcgaaacgtgcctggctggcgcgtaagcccatcagccagggcggtctgctgaaatacgtccacggcggcgaataccacgcctacaacccggacgtggtgcgcacgctgcaacaagcggtacaaagcggcgagtacagcgactatcaggaatacgcgaagctggttaatgagcgtccggcaaccacgctgcgcgatctgctggcaattacgccgggtgaaaacgcggtcaacattgctgatgttgaaccggcaagcgaactgtttaaacgctttgataccgccgcgatgtctatcggcgcgttaagcccggaagcccacgaggcgctggcggaagcgatgaacagcatcggcggtaattcgaactccggtgaaggcggcgaagacccggcgcgctacggcaccaacaaagtgtcgcgcatcaagcaggtggcttccggtcgctttggggttactccggcgtatctggtcaatgccgacgtcattcagattaaagtcgcccagggcgcgaagccaggcgaaggcggtcagttgccgggtgataaagtcacgccttacatcgccaaactgcgctattcggtgcccggagtgacgctgatctccccgccgccgcaccacgatatctactctatcgaggacttagcgcagctcattttcgacctcaagcaggttaacccgaaagcgatgatctccgtgaagctggtttccgaaccgggagtaggcaccatcgcgactggcgtggcaaaagcttatgcggacttgatcaccatcgcaggctatgacggcggcaccggcgcaagtccgctttcatcggtgaaatacgcaggctgtccgtgggagctggggcttgttgaaacccagcaggcgctggttgctaacggcttgcgtcacaagatccgtttgcaggtcgatggcggcctgaaaacgggtgtcgatatcatcaaggcggcgattctcggcgcagaaagcttcggcttcggcactggcccgatggtggcgctcggctgtaaatatctacgtatttgccatctgaacaactgcgcaacgggtgtagcaactcaggatgacaaactgcgtaagaaccactatcacggcctgccattcaaggtgacgaattactttgagtttatcgcccgtgaaacccgcgagctgatggcacagcttggcgtaacacgtctggtggatctgattggtcgcaccgacctgctgaaagagctggacggtttcaccgccaaacagcagaagctggcgctgtcgaagctgctggagactgccgaaccgcatccaggtaaggcactctactgcaccgaaaacaacccgccgtttgataacggcctgctgaacgcgcagttgctgcaacaggcgaaaccgtttgtcgatgagcgccagagcaaaaccttctggttcgatattcgcaacaccgaccgttctgtcggcgcgtcgctttcaggctatatcgcccagacgcacggcgatcaggggctggcagccgatcctatcaaagcgtacttcaacggcaccgcaggccagagcttcggcgtgtggaacgcgggcggcgtggaactgtacctgaccggtgatgccaacgactatgtcggtaaaggcatggcgggcggcttaatcgccattcgtcctccggttggttccgccttccgcagccatgaagcaagcattatcggcaacacctgcctgtatggcgcgaccggtggtcgtctgtatgccgcaggccgcgcgggtgaacgtttcggcgtgcgtaactccggtgctatcaccgtggtagaaggcattggcgacaacggttgtgaatatatgacgggtggtatcgtctgcattctgggtaaaaccggcgttaacttcggtgcgggcatgaccggcggtttcgcttacgttctcgatgaaagcggcgatttccgcaaacgcgttaacccggaactggtcgaggtcttaagcgttgacgctctggcgatccatgaagagcatctgcgtggtcttatcaccgagcatgtgcagcataccggctctcagcgcggtgaagagattctggcgaactggtcaaccttcgccactaaatttgcgctggttaaaccgaagtccagtgatgtaaaagcactgctgggtcaccgtagtcgtagcgcagctgagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcaccagaccaacaccctgccggaagtttgcggacgagtctgcccgcaagaccgtctgtgcgaaggttcctgcactctgaacgatgagtttggcgcggtgaccatcggcaacattgagcgctatatcaacgataaagcgttcgagatgggctggcgtccggatatgtctggtgtgaaacagaccggtaaaaaagtggcgattatcggcgcaggcccggcaggtctggcgtgtgcggatgtcctgacgcgtaacggcgtaaaagccgttgtcttcgaccgtcatccagaaattggcgggctgctgaccttcggtattccggccttcaagctggaaaaagaggtaatgacgcgtcgccgtgaaatcttcaccggcatgggtattgaattcaaactcaataccgaagtgggccgcgacgtacagctggacgatctgctgagtgattacgatgccgtgttccttggcgtcgggacttatcagtcaatgcgcggcgggctggaaaacgaagacgccgatggcgtgtacgcagcgctgccgttcctcatcgccaacaccaaacagttaatgggctttggtgaaacccgcgacgaaccgttcgtcagcatggaaggcaaacgcgtggtggtccttggcggtggcgacactgcgatggactgcgtgcgtacgtccgtgcgccagggagcgaagcacgttacctgtgcctatcgtcgtgatgaagagaacatgccgggttcccgccgcgaagtgaaaaacgcgcgggaagaaggcgtagagttcaaattcaacgtccagccgctgggtattgaagtgaacggtaacggcaaagtcagcggcgtaaaaatggtgcgtaccgaaatgggcgaaccggacgccaaaggccgtcgccgcgcggagatcgttgcaggttccgaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtggtgaccgctattgccgaaggtcgtaaggcggcagacggtattatgaactggctggaagtttaagcgaggtaacaatgaattcgccagactgtgtctggcgaatcaaattactgacgaagtgcgcgttgttttctggcaaatgcggcatgagcgtttgacctttcctataatagggataattttcaataaattgtgctttgttcaccaagtctgatgagtgaagcacatcaagcaatttctcatttacaatccgtctcaattacttgttaacacctctgacaataccgattctgcaagctattcagtcttttcattccatgtaaattgtctcgatattaatatacaaaatatgaatataaaaaaccaatatattatccttaattatctatatattttcctatttttcagcgcaaacattcatgtaatgaataattatcaccacaaaccacctcaccagcaccttattattcacatgatcgtaactataaaattcattaaataaatacatcccagcaagttggctatttctgaacgagttatttatttacattcacaaacagatatatatactgcttcagctttttattttaaaaaataaatttgttattaaggatatgttcatatgtttttcaaaaagaacctcacaacagctgctatttgtgcagcactttctgttgcagcattcagtgccatggcaacagattcaactgatacagaattaactatcatcggcgagtatacccctggtgcatgtaccccagttgttacgggcggcggcattgttgactatgggaaacatcataacagtgcgctgaatccgaccggtaaaagtaataaactggttcaactgggccgcaaaaacagcacattaaatataacctgcacagcaccaacgctaattgctgtaacctccaaggataaccgtcagtcgaccattgtagcgttaaacgacacatcctatattgaaaaagcttatgatactctcgtagatatgaagggaacgaaaaacgcctttggtttaggttctgcgcctaatggacaaaaaattggcgctgcatccattggtattgacaggtctaatggtgggattcacgcggcggacgatacaggtgaaattcctgtcgacctgattcaaactgaccactggtcagcagcgacccccacatggaaagcctcatctaatggcgcattctgctcgctgacaagttgctcagcaatcgagcgcggttattctgttgcaaaaacaggggaactgacacctgttgctattacagcggtcaccttcccgttactgattgatgctgcggtaaatgacaatactattcttggttctgatgaaacgatcaaactggatggtaacgtcactatcagcgttcagtatttataagaacttgtaatacagtttttatttttacgcattaaccagttagctataactcggacagattatgccctatgacatggtctgtcttaatcaatctcatcgcaaacagtgcataacatatattaacaatatgtttctgcgttatttatcattattacaggagttttaatttaaatgctcagacacattacattcactgtatttataacaacatcaatgaataccttagccacagggatggttcctgaaacatcagtattgctggttgatgaaaagcgtggtgaagctagtattaatattaagaatacagatgatcatccttcattgctttacaccaccattgttgatttgcctgaaagcaataaatcaattcgtttaatcccgactcagcccgttattcgtgttgaagccggtcaagtacaacaggttcgatttttacttcaggcgactgttcctctgcaatcagaagagctgaaacgcgtaacgttcgaaggtattccaccaaaagatgacaagagcagcagagttactgtttcaattcgtcaggatctacctgtactgatccacccggcttccctgccggaagagcgagagacctggaaattcctggaatggcgtaaaaatggcgaccaaattgagattagcaaccccagtaattatgtcgttcgtatgaccttacaatttaaaacgctcccttcaggaaaaacgggggctataaataagacctattttctaccacacaccagtacaactactgcattaacaaacgctacggatacaaaagtcgagttttacccagccagccgatatggttatcgcggtaataaatatgtcactgacttaaaataactttgcctggagcgacaaggatgttaaaaaaaacgttactggcctacaccattggttttgccttttctcccccagccaatgcagatggtatagagattgccgctgttgattttgatcgggaaacattaaaatcactaggtgtagatcctaatatatcgcattatttttcccgttcagcccgttttttgccaggtgaatattcactgatagtatcagtaaatggcgaaaaaaaaggcaacattgctacgcgctttgatgaaaatggcgacatttgtcttgatcaggcatttctgcaacaagccggtttaaaaattccttctgaagaaaaaaatggctgttacgactatatattgtcctacccgggtaccacaatcacaccattacctaaccaggaagcgttagatattatcgtttcaccacaggcgatcattcccatagggttggatctcacaaacgcagcaactggtggaacagctgcgctgctaaactactctctgatgagcagccgtgcagaattttctaatgggagttcggactactcccaggctgcacttgaaggcgggattaatattaatgactggatgttacgcagccatcagttccttacacaaacaaatggcacattcagtaaccagaactcgtcaacctaccttcaacgtacctttacagatcttaaaacactcatgcgagcaggtgaagttaacctcaataatagcgtgttggaaggagccagtatttacggtatcgaaatcgcaccggacaacgcattgcaaaccagcggcagtggtgtgcaagttactggtatagccaacacctctcaggctcgtgtcgagattcgtcaacaaggagttttaattcattccattctggttcctgcgggcgcattcactatccctgatgtacctgttcgcaatggtaatagtgatcttaatgtcaccgttgtcgaaacagacggtagttcgcacaactatattgttccctccaccctgtttaatcagcatgtagaaagcttccagggttatcgcttcgcgatagggcgggtagacgatgactatgacgaatcaccttgggtaattagtgcatcgagcggatggaatctgacacgctggagtgcaatgaacggcggcgttatcgtagcagaaaattatcaggcggcatcaatccggtcgagtctggttcccctgcccgatttaacagtgagcagccaaattagtacatcgcaggatacgaaagactcactgcaaggacagaaatatcgtcttgacgcgaactacaatctcccattttcacttgggctaacaaccagcctcactcgatctgatcgccattatcgcgaactgtctgaagcgattgatgatgattataccgatccgactaaaagcacttatgcgcttggtttaaactggtctaactccattctgggtggtttcaacatcagtggctataaaacatatagttacgacggtgacaatgactcaagcaaccttaatattaactggaacaaagcgttcaaacacgccacggtttccgtcaactggcagcatcaacttagtgcttcagaaaataatgaagacgatggtgatctgttctacgtcaacatcagtattccatttggcagatcaaacaccgccacactgtatactcgccatgacgatcataaaacccactatggtactggtgtcatgggagtcgtctcagatgagatgtcctactatgtgaatgctgaacgagatcacgacgaacgtgaaacgagcttgaacggcagtatcagttccaatctccattacacccaagtcagccttgccgcaggagcaagcggcagtgatagccgtacttacaacggtacgatgtcaggtggtattgccgtacatgatcagggagtgaccttttcaccgtggactatcaatgacactttcgccatcgcaaaaatggataacaatattgcaggtgtcagaattacatctcaggcaggcccagtatggacagattttcggggtaatgccgtcattccatcaatccagccgtggcgaacatcaggagttgagatcgataccgccagcttgccaaaaaatgtcgatatcggtaacggcacaaaaatgatcaaacaaggccgtggtgcagtagggaaagtcggattcagtgcgataacacaacgccgtgcattactcaatatcacactttccgacggcaaaaaactgcccagaggcgttgcgattgaagatagtgaaggcaactatctgacaacatcagtggatgacggtgttgtattcctcaataacatcaaaccggacatggtgctagatataaaagatgagcagcaatcatgccgtattcaccttacattcccagaagatgcaccaaaagatgtgttctatgagacagcaacaggagagtgccaatgaaacggataataacaggatgcctgctgctgaacttcgccatggccgctcaggcagagtgtaatatctccagtagcatacaaaatatcgactatggcaaacgaagtgctgccatgcgccaagttgaccggggtaaaacaacacaattagcagacagaacaatcacgctggtaatgcaatgcgatcaggacgctcatattcgtgttcagttgaataccgctaatatttccaacaacggatttggatttggcccgaatggttcattaaatctgatcgccagcgatgcattttcaggtagtaacaatctcgacctggcgttagccagtggcaaaaatgacaatccgggcagcacaggaacagcatcaattagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtacttcccccaataattggctggtgtttatgcaaaatggtcaagaagtggtaattgatagcggtaaaagcgttagcctcacactgacaatggctccagcttttaaggatgaaggggaactaaccgacatgacagatattacaggcaatctgacggtcctggtggaggcaaaatgaacaatgtaaaattactgattgccggaagtgccttttttgccatgtcagcgcaagccgctgatagagtatcaattgacgttaaggtgactctggaagctgcagcttgtactccaatactaagcaacggcggagttgttaacttcggtagtcattcagtcaatagactttcaacgcagcactacacacagattggaacacgtaatattaatatgactataacttgcgaatccgctaccggcattgcgattaccgctcgtgatacacgaatggatagtatgaccaccggaaaagatagtgggggtcagagtggtgtaaaatataccttaaatggcggaggttatattagccagacaacgcgcttattcggcttagggaaaacaaaagataataaaaatatcggtagttatgccgtgttaattgatagcaacaacattagtgccagcaatggtagccagacgttagctgtatcaatagcaggtgcagatgccgtcataacagggcaaaaaagagcatggcaaacgctcaccgcttatccgcttgcagtcgatcaaagctattattacacctttgtaaaaccaggtgaaacaaccccaactcctgtaacgaacgccattataccgcttcaggtgagcgcatctatcgcgaatgatttaggcggttcagaaaaaatcgaacttgatgggaaagctgtgataagcgtagtctacttgtgataacaatgccggacaggagtactatcaggcattcgttttatacgatcggttaatgtttcaggaaagctcttcgcatatcttggggaaagtaaatgtaatacgctgttcttaattgttcagtgctcaccccccagagtatagctcattccattattcaacttagctccatataaagggacagataatggaatcgctctcagaaggaaccacagcaggctaccagcaaatccacgacggtattattcatctggtcgatagcgcccggacggaaacggtacgtagcgttaacgcgttaatgaccgcgacgtaccaggaaattggccgacgaattgtcgaatttgaacaaggtggcgaggccagggctgcgtatggtgcgcagctaatcaagcgactatcaaaggatttatgtctaaggtataagcgtgggttctctgcaaaaaacttacgccaaatgaggcttttttacctcttttttcaacatgttgaaattcaccagacaatgtctggcgaattaacaccattgggaattccgcagacaccgtctgcagaattcccatcggcaaagatttggcagacgctgtctgccaaatctttccccttgcccaggtccacctacgtccgtttactttccgttaaaaacgctgacgcccgcagcttttatgaaaaagagacgctccgctgtggctggtctgttcgccagctagagcggcaaattgcgacccagttttatgagcggacactactgtcacatgacaaatcagccatgctgcaacaacacgctcctgccgagacgcatattcttccgcaacaggcgatacgcgatccctttgtgctcgaatttctggaattgaaagatgaatattcagaatccgattttgaggaggcgctgatcaaccacctgatggatttcatgctggaacttggggatgattttgcctttgttggtcggcagcgaaggttacgcattgatgacaactggtttcgtgtcgatctgctgtttttccaccgccgtttacgctgcctgctaatcgtcgatctaaaagtgggcaaattcagctatagcgatgccggacagatgaatatgtatctcaactacgccaaagagcactggacgctaccggatgaaaatccgcccatcggtctggttctctgtgcagagaaaggagccggagaagcgcattatgctctggcaggtttgcctaacaccgttctggcaagcgaatataagatgcaactacctgatgagaaacgactcgcagatgaactcgttcgaacacaggcggtgctagaggaaggctatagacgccgttaatttcagcggtttcgaattctgcagacagtgtctgcagaatctttaaaacgaactaagttttaagccattaaatcagccttaaccttcaccacaacctttttaatctctccaggctcgccgacaacgcatcctggtttatgcggttcacctggcataaacacggcgaacattcccggttttaagatgatggcttgctcgttatcaatggtgctgcaaagctgataatcatcctcatggtggaactcttcacactgacgcgcagtgcctgccatgccaaacagaatccgttcctcaccgtttaataacagctggatatcaatgtattgctcgtgcaattccgcttttttctcgacgggcgattgagtgttaaacgtcatgacattcataaagatattgtcgccctgtaattcgtaacgacccggcgctttttcttgcggtctggcagctaatgccagcgttaacgcgtcctgtaacgcaggatgtaacccagcagacggtaatgactgtacttcacccatcatcataatttttctccctgggccaacagcgcagccccaagtaaacctgcatcatggcggtaatgcgccgccagtaaatcaacatgaaatgccgctggctcctgcgccagatacgtttccaccagcgccagatacccttctgccagaccaacgctgccaccgaccaccacgcactggcaatcagttgtggctttaatatcagcgatcagccttgcaagcgtacgtgcggagcggtgaatcagctgctgcgcctgctcgtcaccctgcccggcgcgcgtgaaaatagttttcgcatccgcgccagccaactccccctgcgctgccgctgcaatgccgcgaccagaagcaatcgcttccacgcaacctgtgcgtccacagccgcagactgggccgtgtggatcggcaagcgtatgcccgatatgccccgccagaccgccagggccggtaagcagtttgcagccgctcactacaccgccgccaacgccggtggaaacggtgataaagaccatatcggttatatcgccatccagcgcctgaaactccgcccatgctgcggcctgcgcgtcgttaatggcaatggtcggcaaattggtaagttgttccagcgttttgactaacggaaagtgtagcaatccaccaagattatgcggattaagcgccagcaagctgccgtcacggattatcccggtcgaagcgatggcaacccgctgcgcatgagcttgcaacggagagactaatgcggataaggcatcacgcaaggcttctggtgtctggctggctggcgtaggaagttcacgacgatcgcggatctgcccgtcagcgccaatcagcgcggcggcaagtttagtaccgccgatatcaatcgccagtgtggtcatagcaccgcctttttcatcgctgtgttgtaccactgacaaatgtgctcaagacgcgtgattgcagaaccgaccgtcaccgcccacgcgccgtggcgcatcgcatccgccgcctgagcaggcgtgttgtaacgcccttcggcaatcacccgacatccggcgtcgctcaacgttttcaccagcgccagatccggctcttctggcgtttcaggcgtggtatagccagaaagcgtagtgccaataatttcggctcccagcttttggcatgccaggccgtcttccggcgttgagcagtcggtcatcgccagtaaaccgtgatggtgaatacgtgccagcagcgtttcaacaggcaccggacgcgggcggtcggtgccgtcaatggcgataatgtccgcgcccgcctgcgccagcgcatcaacatcttcaatataggccgtgatgcgtaccggagaatcctccagatcgcgtttcacaattccaataatcggcacgctcaccaccgcacgcgtggcttgcagatttgccacaccttcaatgcgaatggcaaccgcgcccgcctgttctgccgctaatgccatggcggcgacgatttcgggtttatcgagcgggctgtccggaaccggctggcaggagacaatcaggccaccgttagcagcgattttttgatccagttgtgcaagtaacgacatacatcttcccttagcgaaaggcccggtacatagaccgggcaacaggattaacttttggttttgactaaatcgtttttggcgctgccaaacggcacggcaccgctgaatggtttaccgtcgatagcgtcatgagtacgcaacgcttccgggcgcaaccaacgctgaacgcgagaaggcatatccagcccaatcagcaggatcaccacgaacgtcagactgaacgagagcgatgccagcgcagtacccagatccagacgttgagcgatcaacgcgccgatgattggggccagtgcaccgcccaatgcgccaacgttgtaggtaaagcccaggcccgctgcacgctggtcggtatcgaaataaccgccaatcagttttggtaagatcccggcgatcccttgtccaagcatttgctggaagaacagtaacagaccgagcacccagacgtttgcgccgccaatcgcaaataccggaataatcagcagctgcgaggccagcaggctacaaacgtacgctttgcgggttcccagccagtcaccgaggaagccacctacgcagcatcccaccgccgcgccaaagccactaaagaacagcacattggctacagtatgcgggttataagccagatcggttttcagatacgttggcagcagcgcctgaatcggccatgagtagaggaaagcaaacaacacgaccaccatcagcattacgcccgttggccagcgtttgcctgcactctgcaccataaagctgataaagattgcggcgcataacagcccaagaacagcgacgatcgcggcattttgcaggttaccggcgaagcagaaccacagcgcagtagccgccgccagtgtcattacgatattggcaatgcgatgttcaccacggtagagaatatccaccattgtgcgtactggtgctttacctgcgtgtttctctttccagtcttccgcttccgggatgtttttacgcagccagagagcaaagatgattggcaaaatgccgataaagaacagcgcacgccagccccagaccggaaccaccaggctatagacctgagcggcaacgacggcccccacagagaagcctgaaatcaaaaaaccactggctttgttacgcagatgttttggccagctttcaatgacataggtggcgctggaaccgtattcacccgccatccccatgccgatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcagagatcagacttgccgcctgcaccgtcgtcagcccgaattcaccttgtacttcggtgagtaccagggcgattaaaacgaaatcaaaaccgtcaagcagatatcccaaccaggcagcggaaaatgcgcgccattgtgcacggttgagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggtccaaacggtttgcggcacagcggcacagaaacgacatccatataatggaggacagttttcaggccgcggaatacgcccgttttgatcagtaaatcaatgactttattgcattcagtttgcagtttctgcgcggtctggatatcgccttctttcagcgccttaacgatcccctgatagcgccagcccatgatgttgtaggtactgccgataccaccatcagcgcccgccagcagaccagaggcgaagatttcgtcgtaaccgttatagagcacaagatcaggatgttcacgacggatctgctccatctgatagagatcgccagaggtctgtttcagcgcacctacgccaggcaatgtaacaagtgtgttgatctgatccagggtcagttttaccccactcagggctggaatgttgtacaccaccatcggcaaaccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcggcgacgatttccagtacctgttcacgctcggaaaggctttgtacaaaggcctcgccggtcgaaccacccacgtataaaccgtcgatgccctgctgaatattgaactgaaccaggcgacgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaagcgtgccaggtagcagagacgctgttgagatgcgattgcaacgcacgatcggcttcgtcaggatcatgacggcggatcgcatcaacgatcgcaatatgctgttgataactaacgttgttatgttcgtgcagtgcctgatcggtaaccgttgggcgtgcggcaataagccagtcgagcagggcaacgtggatcgccatgaagattgggttaccggggatctccgccagcacgcggtggaaatcaacgtctgaacgaatgaatgccgcgttgttatccagcgactgactgttgatttccagtgcttttgccagcaaatcgatttgctcatcggtggcatgttcagccgcatagcgcaccagactggattcaaagaacagacgtaattgttcgaaatgggcaatcccaccgggatgagaaaggaaatctttcgccatgccggaaagctcaccgatgatagtgtccgcagaaggacgcgagacgcgagcgcgttcgccgttgtttatttgcaccagacctttgcgttttaacgctgccagcgcttcacgcaccgaaggacgcccgacgttaaagaacgccatcagttcgcgttcagacggtaattgttcaccttcgccaaattcacgacggcggatcatctgttccagctcttcttccaccatttcggagagttttttacgcgccagcgggcggctacgcaagttgcgaccaattgcaggtgaagaatcttcggtttgcgaatcaaatgcgttcataaggcccattctgtaaggtcagtgtgattaacatcatcagtgacatcctatcacaggattgaaagtaggggaaaatggcagggttttctctttgtgcctcatcattaccataattaacggaataattaactattgcgaaaaattaatgtaacgcagataaaaacatcccgtttgaattatttataagactattcacgagcattatgaatattatgaatgtgttcttacaaaataatcataagcgcatattttttaatgaaaaatcacctcacctacaattaaaaacacgacatccgcaccataaatagccttgcaaaaaatataacatcgttgttttcaatctgccgtttatgggattgaccgttttcttttgacacggagttcaacaatgttcggcataattatatctgtcatcgtattaattacgatgggctatttgatcctgaaaaactacaaacctcaggtggtgctggctgccgcaggtatcttcctgatgatgtgcggtgtctggttagggttcggtggtgtactcgatcccaccaaaagcagcggctacttgatcgtcgatatttataatgaaatcctgcgcatgctgtccaaccgcattgccggattggggctgtcgattatggcggtgggcggttatgcccgctacatggagcgcataggggccagtcgcgcgatggtgagcttgttaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgtctctctgcggtggcagttatcgcaaccacgatgtccattgagtgggggattctggaaacgaactccatttttgctgcccaggtagcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctgttcctcgcccacgtcgggctgatgcagtcagaactgcatctggtggtggtgatgttactgagtttgactgtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggggcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaagtcattaaaaagacaaaacaggccgcctgggcctgttttgtattacttcacaacgcgtaatgccggtcgaccaccgcgtggtggctgcggaggttcatcgtcaggatgagtgtcatcatcgtgatctggcttgtcgccatcaataaccgacataacggtttcgttgtctgccgatgcctcttcatcattcatgatgctggtatcttcatcgtaggcagcttcaggctcaaacatcgtgcctgcgccattttcacgggcgtagatagccagcacggcagccagcggcacagaaacctgacgcggaatgccaccaaagcgcgcgttaaagcgcacctcatcattcgccagttccagattgccgacagcacgcggcgcaatgttgagtacgatttgcccgtcacgcgcatattccataggaacctgcacgccagggagcgtcacatccaccaccaggtgcggcgtgagctggttatccagcaaccactcatagaatgcacgcagcagatagggacgacgtggtgttagctgtgacaaatccatacagattaactccggcccagacgcatttcacgttctgcttcagttaaagaagcaaggaaagagtcacgctcaaagacgcgggtcatatagcctttcagctctttcgcacccgggccgctgaactcgatgcccagttgcggcagacgccacagcagcggagcaagatagcaatcgaccaggctgaactcatcgctcaggaagtacggcttctgaccgaagaccggcgcaatcgccagcagttcttcgcgcagttgcttacgtgcggcatctgcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccaataaggaacgactctctttgttcgaaaatcaaacaaaaaatgagcaatacccgacatttgggcagaaaattggatgatagtttaccagattttgcgaccattgtggtgagtcgatgccggaaatggggaaaaagagatgcgctttagtctgaaatagttgacttagtcccttattggcgatgtggtttttgttttacctgtctgtcaggtggcagcaaaaagcaactttccagtttttacgctgattcagattttagctataaaaaaacccgccgaagcgggttttttcgaaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgggcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagttttgggaaaaaaactttcttgtaacgtggggtcgcaggattatagagaagtcggggtcaaagatcgacccctttttgtgatttgtgacaggttttaacccgccaaatgctcgcgcttcagatactcttcgctttgcatctcttgcagacgtgacaggcaacgctggaactcaaacttcagccgatcgccctgataaatttcatacagcggcacttctgcactcaccactaatttgacatggcgctcgtaaaactcatccaccagcgcaataaagcgccgcgcttcgctctccatcaaccgcgtcataactggtacatcaaacaacatgaccgtatgaaagagacgtgagagcgcaatatagtcatgctgactgcgggcgtcgacgcacagcgtagtaaaagagaccgccagcgtctggttctcgacgcccattgttgctaatggccgatggttgatttctaacgtcggtgaattttctcgtttcccccccgccagcgccaaccatagtttatccatttgcgcccgggtttcatcgtgaagtggcgaaagccacagatgcgcctgagtgagtgtacgcagacgataatcaacaccagcgtccacgttcattacatcacaatgctgtttaatggcatcgattgcaggcagaaaacgcgcacgttgcaggccatttcgataaagttcatccggcggaatatttgacgtcgctaccagggtaataccgcgagcgaacagggctttcatcagaccgccaagtagcatggcatcggtaatatcagaaacaaaaaattcgtcaaaacagagcacgtcagtttcggctttaaagcgatcggcaataatttccagcggatcggtctgcccctgtaaggcagttagctcttcatgcacccgcagcataaaacggtgaaagtgcaggcgctgtttccgctctcccggcaggctttgatagaaaaggtccatcagccaggttttcccgcgtcctacaccgccccacatatataagccacgcactggcgtatgctttgtgtcttcgcgtttaccccacagcttaccgacccgcgccattagcccactcgtcctgggggctggtggcgtgctattgatgagttcctgataaataatttccaggcggctgacggcctctttttgaacgtcgtcgggttgatggctgccttcattaagcgccttcaggtattgcgatgttggggtaacgctttgcatgatcttattgttattccttgaataatcggtgcgccgttgttcacggttgacgaaaaaaaggccgttctacactacgcgatatgcagtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccctctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccagtaaaggctatgtgctgaccaacaaccatgtgattaatcaggcacagaaaatcagtattcagctcaatgatgggcgcgagtttgatgcaaaactgattggtagcgatgaccagagcgatatcgccctgttacaaattcaaaacccgagcaaattaacgcaaatcgctattgccgactccgataaattgcgcgtcggtgattttgccgtagcggtcggtaacccatttggccttgggcaaaccgccacctctggcattgtttccgcattaggccgcagcgggttgaatcttgaaggtctggaaaactttatccagacagatgcttccattaaccgcggtaactccggcggtgcactattaaaccttaacggtgagttaattggcatcaacactgcaatccttgcgcctggcggcgggagcgtcgggattggatttgccatccccagtaatatggcgcgaacactggcgcagcagcttatcgactttggtgaaatcaaacgcggtttgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggcggcaaaggtattaaaatcgatgaagttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcatcgccctgcaaattgtacgcggcaatgaaagcatctatctgctgatgcgttaatgtcgtaaaccgggcatcaggcttacgtgtgatgtccggttaactcgtggtatgctgctgccgttcccttttttaatgacgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttacaaccgtggtttgaacaccaactctcacaaccagcttgagatccgcaccctgggatccggtgtaatcatggatcaacgcggttatatcatcaccaataaacacgtcatcaacgacgccgatcagatcatcgtcgccttacaggatggacgtgtatttgaagcattgctggtgggatctgactctctaaccgatctggcggtacttaaaattaatgccactggcggtttacctaccattccaattaatgcacgtcgcgtaccgcacattggcgacgtagtactggcgatcggtaacccgtacaacctcgggcagaccattacccaggggattattagtgccacgggtcgaatcggtctgaacccgaccgggcggcaaaacttcctccaaaccgatgcttccattaaccacggtaactctggcggcgcgctggtgaactcgctgggcgaactgatgggcattaatacgctgtcgtttgataagagtaacgatggcgaaacgccggaaggtatcggctttgcgattcctttccagttagcaaccaaaattatggataagctgatccgcgatggtcgcgtgatccgcggctacattggtatcggcggacgtgagatcgcaccactgcacgcgcagggcggtggtatagatcaactgcaagggatcgtggttaatgaagtgtcacctgacggcccggcggcgaatgcgggtattcaggtcaacgatctgattatttcggtggataacaaaccggccatctctgctctggagacgatggatcaggtggcggaaattcgccctggttcggtgatccctgtagtagtgatgcgtgatgataagcagttaacgctgcaggtcaccattcaggaatatccggcaaccaattaagtcgtgcgctcaaaacaaaaaaccggagtctgtgctccggttttttattatccgctaatcaattacttattaacgaactcttcgcccagggcgatatctttcttcagcgtatccagcataccttccagcgcgttctgttcaaatgcgctcagggtaccgatagatttacgctcttccacgccgtttttacccagcagcagcggttgagagaagaaacgggcgtactgaccgtcgccttcaacgtaggcacattcgacaacgccttgttcgccctgcagtgcacgaaccagagacagaccaaaacgtgcagctgcctggcccatagacagggttgcagacccgccaccggccttcgcttcaaccacttcagtacccgcgttctggatgcgtttggtcagatcagccacttcctgctcggtaaaactaacgccaggaacctgtgacagcagcggcagaatggtaacaccagagtgaccgccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaattgcaactgtggtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcgccttccagcgccggagtcgcatcttcaccagaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcgcttatgcattagcgcaacattccaacaggtggtgacaatataccctaccgttcagccaaaacaacatcaatttgataacaattaatttacttttaagcagaatttgcatgccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgtcgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtgctggatatcgactacaacgatgcagttgtcgtgattcataccagccctggcgcggcgcagttaattgctcgcctgctggactcactgggcaaagcagaaggtattctgggcaccatcgctggcgatgacaccatctttaccacccctgctaacggtttcacagtcaaagacctgtacgaagcgattttagagctgttcgaccaggagctttaatctctgccccgtcgtttctgacggcggggaaaatgttgcttatccctctcaaccccctgctttcccctgcgattaatttaacgaatagtgcgttttactgcgacatgtcattcacacaatgaatacataaggtaaaaaaagcacattatgcaaaattcattatctaattgaaaaaactagaattaacgataaataaccgtatttttaattcttttttgttattaaaattcacatttttaacacttagtatcaactgaaacagttagcgcggtattaattagctcaataattagtgtatacttgattttgtgatatgggtcacgaaacaaaggcccagctaaaagattatgtcgaggtaaaaatcatgaaaatcaaaaccactgttgctgcattaagcgtactttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagcggtgacacctggcacgctacggctgaactgtacaaataaaccctcatcgtcttgtccgacgatattgcccccggttcgggggcttttttttgcgctaatgacgaacattaaaacgcaaatgcccttccagctcttcctctgcctcatcaaacagcaatattaacgcgccaaaacggcgacgcgttttctctcccagatgaacaaattcaatctcaagtggtagcggcaggacatcgttcattaacacatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgtgcatcgctaagtatagccatgaaaaaaccgacgcttttggcgtcggttttgacttaactatcggtcaacgcatgttgatacttatggagcatccccgccagccgatttaccggttccgtcacctgcggtggcgcttgccagatgcgtagcttttcctggtagatttccagttcttccagcaactggccaaagtaccgacgacgtttatcatcgctacgggcagatatcacatggtctgctgtgcggcgcatttgtcggtgaaacgccgataaatcctcgttaaccgggatcggtgcatcacgcaggcgctggtgcgcgataatcatcgtcagcgccaggcgaaatttcggcaaatcccctgggaacttattcatcagcaaaaacagctgctgataaagtgccgggaggtggttctctttacgacgtgccacattggtagtcatcgcggaaacagcggcagaaacaaactgattaagcagtacacgtccggtcctgtcgcgcgatttatcccgcaccagcaaaataacggtgaacgcgagcacacagccgacgatttgccctaatgcgctgtcgagaaactgactgaaatggaaagtcatcgggttatccagcacgataatatttatggtgctggccagtgcccccatcgagcccagtcgccgtttctgtacttctataccgaggaagaatcccagcactgccaggctaatgcacagcagcaacatgctctgttgggtattagggataatcaccaaaaagtagagcagccctaacggcagcgcggccagcgtcccgtagataaagtcgatcgccaccatgcgtggattcggcaaacgcattgccagtgacgtcactaccgcaatcatcaccattgcaccactgccggaagtccagcccgtccacagccagaaaagcgtgcccagaatgcaggaaagtgtggttcgccagaagttaaccattgcatgatgacgttcggctgactctacttttacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactctccgcaggcgtttgagctgcttgtggacgtcctgcgcggtttctaccggcgtgtcaaaaaattcgcggaaagtatcagtgatcaattccgggcgcgtattctgaataagataagtttcgcaggattgggtaatcagcgtcagcgatagcgtattgatcgcttttaaacgtcgattggcccgcgcccagcgggaagattccatattcaggttgctgcgcatgccttgtagcgccgtggtgcgtcgcaccaggtcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataatcgcacacacaataccgataacgatctcgctacaacgttcgacggcaaactgcggcgtaagcaatggttccggctgaatggtgatcacaatgatcagcgcggtataaccggccagcccccacgcatacgagttttctattcgtaccagcgaggatatccaggtacaaaaaccggcccagatacagcacaccagaatcatcaataatggtgcgcggatcatcgcaatgatgatcaccagtccggcaatacagccaataaatgtgccgatgatgcgcaaaaagccacgatagcgaatagcgccagaatacggttcacctcccgcagcaaaggccgtaccggcggcaacaatcgccgctgtcagtaccgcccagcgtggcgtttccagctggaagtgaaagccaacaaacagcgccagtacaatggcggtcgccagttttaccgcaaagcgaatatgttggttagcaatggagaaaatacccatcgtgattaaccaaactcacgcaggcgatgggccattttacggaagaacgaatcctggctttcgtcgcgatcttgtttgccagtgaccaccactgtagcagtggtgcccgcaggccagatgttctcttgctggttgtcgagacgaatacgaaccggaacacgttgcgcaagacgcacccattcaaggttagagtctatagtcgccatccctttgtcgtcacgcgtgctgctggcgttggtgacccctgcggcaacactatcaacagtccctttcagcactttgttactgccaagcggcgtgatctctgcacgataccccggacgcaccccttccagcttagtttcttccatataggccagtacatagaaggagttctgtttcaccagcgcaaccgccgttgatcctcgagtaataaactcaccggtatagacgttgaggttggtcacccagccatctgctggcgcgcggatcaccgtgcgttcaagatccagttttgccagatcgcgggtcgcctgcgctttcgctaactgatgcagaaccgtttgtagtacgttgttggcctggtcgatctcttcgcgagacatcgcctgcacaccgagacggttacgacgtccggcctcctggcgtttctcctgtgccagtacctgataataagcaacatcggcttgcgcttcctcaagcgccttttgatagcgcggctggtcgatggtgaacagtatctgtccttttttcaccagctggttatcatgaacattcacctgggtaatgagtccagaaacgtccggcgcgatcgcaacgacgtcagcgctaaagcgcgcgtcacgcgtccagggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtagatacctgttggcacaagtacccggcgcaccagccagaaaatcgccagtgataaaagcaattcaaaaaatatcggtgggaaggacagcccaaacaccacgataacgggaaacagactcatgttgaccttggttgtaaagagagagcaggcgttattattttcagcatctgtcgccgcagagaagggcatggaaagccgggcgagagcaacattgctgtagattgatatttaatatattagcgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtatcaaaactggaagatgagttgcaggtaaagctgttaaaccgtagcacacgcagcattggcctgaccgaagccggtagaatttactaccagggctgccgtcgtatgcttcatgaagtgcaggatgttcatgagcaactgtatgccttcaataacacccccatcgggacgctacgcattggctgttcttcaactatggcacaaaatgttctcgccgggctgacagccaaaatgctgaaagaatacccaggtttgagcgtcaatctggttaccggaattccagcccccgacctgattgccgacggtctggatgtggtgatccgcgtcggcgcgttgcaggattccagcctgttttcccgccgtctgggcgcgatgccaatggtggtgtgcgccgcgaaaagctatctcacacaatacggcataccggaaaaacccgccgatttgagtagtcattcatggcttgaatacagcgtgcggcccgacaatgaatttgaactgatcgcaccggaagggatctcgactcgcctgatcccacaaggaagatttgtgactaatgatccgatgacgctggtgcgctggctgacggcgggtgccgggatcgcctacgtgccgctgatgtgggtgatcaacgagatcaatcgtggggagctggagatcctgctgccgcgttaccagtcagatccacgcccggtttatgcgttatataccgaaaaagataagctgccgctgaaggtacaggtcgtgatcaactcgctgacggattattttgttgaggtcggtaaattgtttcaggagatgcacgggcgcgggaaagagaagtaattcatattgtactgttacgttgtacaaacctgtgccaacgggttcccctcaccctaaccctcaccccaaaggggcgaggggaccgttcgtgcacgtagaaagattaattatccttctgaaaatagtgaaattattacgcagtaccgccaacagtcaggttatcgactttcaacgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttcgttactttaccgttttcaatcagatatgcttctgaagtggagaaaacgaatttgccggaggtgatatccacctgaccgccaccaaagttcggtgcatagataccgtactcaacggattcaataatttcctgcggggtcgatttacccggcagcatataggtgttggtcatacgcggcatgggcagatgggcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaacctcggcgatcgaccatcgtgccatcatcaaccacggtacacagttctgaagccaccagctccccgacctgtccactaaatactgaagtgccacggcggttgaagtcgccttccagaccgtgaccaaccgcttcatgcaacagcacgcccggccaacctgcgccaagtactaccggcatggtgcccgctggtgcagcaacggcagaaagattgaccagcgccatacgcactgcttcttttgcccatgcatccgcacggacttcgccgtcgagatcggcaaggaagaattcataaccaaaacgaccgccgccgccactggcaccgcgttcgcgtttgccatcttcttcgacgagaacgctcacggaaagacgcaccagcggacggacatccgccgctagcgtgccgtcggtggccgcaaccaaaattaattcatagacaccactgaggctggcagtcacttcctgtacgcgcttgtccgcttcgcgggcaaccttatcgacgcgacgcaggatatccagcttctcttcacggctcatgctttgcagcggatctaccgaggtatacaacgggctatgctctaccgcgcccagcgtctgtactttaccatcaccactatcacggacgatggtgcgcgccgcttgcgcactctgttccagcgccagcaggctgatttggtcagcgtaagcaaatccggttttttcaccgctgattgcacgcacaccaacgccctgatcgatgttgtaagaaccatctttaataatgcggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttaagactcatcgtttttgctactcgttagttactgcagtagaggattttttacggctgccggatgcggcgtgaacgccctatccagcctacggttatgttccggtttgtaggcctgataagacgcacagcgtcgcatcaggcaacggctgtcggatgcggcgtaaacgccttatccgacctacggttatgttccgtttgtaggcctgataagacgcacagcgtcgcatcaggcaacggctgccggatgcggcgtaaacgccttatccgacctacggttatgttccgtttgtaggcctgataagacgcacagcgtcgcatcaggcaacggctgccggatgcggcgtgaacgccctatccgacctacggttatgttctggctcgttggcctttggcaacgattatcctatgagattggggcaattacgcgccctcgtcaaatcattgcgctttttctttacgcggttggcgcaacacttcgttgatttgcggatcgtccagcggacccgaaatgtgatagcgcaaaatggagactttgctccacagcggccccagcactttactggcggcaaacactgccgcgccaacaatggggttaaccgcaaaagccgcagccacgcccaccgtcgcagaaatctctggtgcgacaaccgcttccatattcaggtcgcgacgtaccagatttaccgaccctttcatggcgatatccgcctccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcttcatctggctgccagggtgctttgcgccagtgtaaatcgtaatccacattaaatgacgactggcgtatgggcgtcgtgacaccaaaaaattctgcggcggcatcaattttctgcccgcgcagttttcctttcagcgaggtacgttcattccccggattattaacccattcaccatcggcagtaagccgcgagaaaccagtatcaatcagtccattggtcagcgttaacgtatcgccagaaatggtgatatcactgtcaatgcgaccgaatttttgcccccagaaccagcactctgtgcatcgtatttgggcgtccggccagccacggaagttaatgcgctccgttgtcgggaaaggtgatgacggcgttgaatcaccacgagttttcgccacgctcgggttgtaataaagatatttgatattcgccagccacggcgcgttattacgcatcgctagcgtggcgttgatttcacgcccttgcgcttcaaccagggtgccatttgccgtcggttgcgaaacaatactcaggttattccattgctgatttcccagtgacaacataggcgtacgtaacgttatgtgttgtgggaaactcgctgcaccaccgacactctccgcagcgcctttctggaacagggccagccactcggcaccattcatcggcggcatattgagttcaacgccactttgttccggcaacggcgggagcgttttactgtctgccgcccaaatagcacgatcgagcgtcagcttttgaccgagcaaccagcggctattgaaatgattatccgcaccagcctgtccggttaattcaaagctgttgagattgccatcaaccttaacgtttaccgctagtggttcacccgcaggtttggctaacggtgaaggtaagtgactgctcacattctttagatcgccgttcagctctatgttataggtcgcaccagcatgataaggcagatcaatgcccactttaccatcccacgccacgctgccactcaatgcttcgttcaccgcttcaggcagaacgccggttttcgccggttgccagttaccgttgaggtttaccgctacctggtaggcttttgccccttctttggtggaaaaatccacgttcaacggctgattaaaccagcttgctgtcagtggttcactttgcagatcgctattgataaagctgaatttaccgctcaaatttttcagggtgctgtcgagtggtttgataaacagactgttattacgcagcgtcacttcacctttcgcggttaccagttcgccgttcagcgggatatcaagatgtaagcgagcattcacatcgccgtcgagctggagttcttgcagggtcgcacccagagaatctttcagcggtgtctcatcaaagtaagggccaacggctttacccggacctttaatgtcagcgtcaatcagcagtttttcttttgagtagtcagggatcactgcggtaagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgttattgttcagccagcttatagttgcctggccgtcggcgatttctagtggcgcacggaataccgtttcgtaaggcatctttgcctgcttcatcgacgcggtaagcaaaccattttcaacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcggccagcgggcgtatgccctccaggcctgccagctccagattactggcgcgaatccggagttcgtcactgcgtttattgtctttgccgccaacgtcctgttccggtatccaggccagcgtcaatgctccgctcggccagggtttgccgtccatcgtgatccgtgtatcgggaatagagaactgccagcccggattttcacgcgtaatatgcgcggtcagattatccaccgacagcgtatgcgtttgcttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatgcgcacctgcatcacgccgtgctgtccggtaaggctggagaggcttaccaggccttccgcacggtgtcgacgtggatcgttcagccaggtgagttgtgggatcgccagctcggcgcgctgaccggatggcgtcaggaaactgacttcactgtcgcgaagatcgaaatggtcaaattgacgaagaaacagatcgctgatgtgactggcttccagactgtcatcactaccaccgctggtgataggagtgttggtgcgaaagcgcagctgccagaaagtgaggtcgcgaaactgccagcgcatatgtaacaggctctgccagacatccagcgccagagtaacgcgtttaaccgaaaattcgccgccatcttttagttctgcacggatgtcgtgtgcttcaagcgtcgggccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcagctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccggtctttgctcaacgcctgctccagcgagtgcagcactcggcggcggtgatcttcattattcatatcgatgaaatcaataatgataatcccgcccagattacgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatgagataaccaccggatttcagttctactttgcgttccagcgctcgctggatttcgttttcgacatcaaagagatcgaaaatcggctggcgtcctgtgtaatgctccagcttgcttgtcatctcgggaatgtactccgaggtgaactcaagtaacgcttcgtaagtcaggcgtgagtcaacgcgaatgcggtccagttcggcatcggcgaaatcacgcagaacacgctgcgccagcgccagttcgccgtacagctgataacgggtctgcgggcgttttttacgctccataactttggtccagacgcgtttcagataagcggcatcggaggccagttcagcctcgccaaccccttccgctgcggtacggatgataaacccgccctgctcgtcgcaatactctgcgaccacttttttcaggcgttcacgttctgattcgctttcaatacgttgggaaaccccaacgtgagaagcccctggcataaacaccagatagcgagaagggagcgtgatatcggtggtcaggcgcgcacctttagtgccaagcggatctttcaccacctgcaccatcagatcttgcccctgacgaaccagttccgagatgtcgcgcaccgtgaattgcttttgttcttcacccgccacacattcggtgtgcggcatgatgtcggatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgcgtttccgaaggcgttacgtttactaacaattcagccgtcatgtttatcccttttctcacgcagtgcgttaaaattacttaataattcatacgtttcaaccagcggtaagccgactacggcgtgatagctgccatttatcttcctgacaaaacagccacccagcccctgaataccgtatgcacctgctttatctaacggttcatcgctggcgacatagcccgcgatgtcttcgtctgttaacgttctgaaagtcacatcggtgaccaccaggcaatcgagaatgtgctggctgtcggccaacgccactgctgtcatcacctgatgggtctgacccgataatttgcgcaacatctgcgccgcatgctctgcgtcgcgcggtttctccagcacttctccgttcaggataacgatagtatccgcacccagcaccgggagatccttcgccgtttgcgcgacacctgcccgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttgcgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatgaggcaaggccaggatccaatacaacaagatgagtaacacccagtttggccggaaaacaatcaggttatccggccagggcatgatttgcagcaacagcgcaatgaggaaagagagccagattacccagcgtccctggctacgatagctcgccactattgccctcccggcgcacgcgcaggcggttgagcaccactttgcggcggcgtagccctttgtggagagcgattagcagcaggctgtgtcggcgcagcaggcgcagtagctgcatttcctgtcgccggttgctgcggagtcggctgagcgatccccgttgccggttcaggtaactttggccccatcgcgtctggcgaaggcaatacctgcggcatcatctgcatcagacgttcattagcaacacgatgcacctcttccggcgtcatcgggttagcgccgttacgatctgccccccacagcagcagcagataacgcaaacgttgcagccctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgccggcagatgctcaagctgcaaatcatccgtacaaccgttaccggctgcaattacgcggatatcgttgcgcagcacctggattggcagcgcgtgggtcgcatcacaaatcagcagcacgcgactggtcagtttagcgacggccaccacctgaccaacaacacctttgtcgctgatgaccggctggccttcataaacgccattaacgctacctttatcgataacaacttgatcgctataaggatcgttaaccgtggagataacctgagtcaccattttctgctcatcctgacgcagcggggaacccagcagctcgcgcagacgcgcgttctcctgtttgtattgtccaagcatcagcagttcactgtttttcagcaacagttcctgacgtaacgcccggttttcaagttctaattggtcacgcgaggccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatgtcggaagccagttccggcgggcactgttccagtgcaaccattaccgcgctcacaataccggtcagcggttcctgcagtgcttcgaggatttcattggagttcagggtaaaaccgcgtggaacaccttctgccaggttacggccacgaacttcgatttcacggacttcatcgcccggataagccgaaccgatttcgtgcttgatacgttctgcggtggcttcaccgatcagagaaccgtaattacgacgcacatagttgatgatagcttcgtcgaaacggtcaccaccaatgcgcacagaagaggagtaaaccacaccgttcaaggagataacagcaacttcagtggtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcattattctacgtgaaaacggattaaacggcaggttaaaccgagtatctttgtgaatattttttcacgttagtatcaagtggctgtgaggacgcgaaaaaatccccttgcccgcctgtaacaccgcgctgaatcagggtctgccactcgcttcgcgaacgcacgccggtggcgtaaacctgggtgctggtcccggagcaggcttccaccaggctttgaaccagcagctggttctccgttcgcttctcaatgtttctgaccagccccggatggagcttgagtaactcaacattaagttctttgatccaactggtacttaccagcgtcaaaccagcctggttgacggctacccgtacccctaaagcattcactaaacgaataacaggttgtaaacgactgatatgttgacctacatcggcctctgcaagttcaataattatgcgttttcgttgtgatttttcacattgcattaacgtatcgcgcagccaacgctgaaaacgcgggcgaatcagcgactcaacggtaacctgaatcgccagattttcctctggccagtaacgcaatagtggaataagacggctgatttgcagacggtcatactcttccgataagccaaactgcaagaccatcggcatatactccgccgagctaacctcttcattaccatcgaagatgcggcacatgagttcgcgatgatgaacctgaccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcgcagataccaatgtggatcatatcgtcgcgatcgagcattttattgttcggcaaggtatcaacggctttgattaactgaccggcgatgctctctgcctcttttaacgtccggtgcggtaacagcgcagcaaaatcactgcggtggtaacgcgccagcagtgcgccagggtagcgcatcataaatgtcgacagcagattcgtcagagtgaagaactgttcttcaacctggctgtgcccccaggtatcgctcaacatattgaaatccggcagacgaatcatcatcacgatcccgtgggtacctactttctcctgatcttccagtaacgttgctaactgattatcgaaaaagagtcggttattgaggccggttttcacgtcctgggcggcataagagcggatcagcgtatcaagacggctgtgttgttcgcgtgcgttctgaatttcacgaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataacaatgataaagccaatcgcccccgtgagcggcgcggtggtcatcaacgaatggaaatagttgcccatcggatcctgataaaccagacgcaacgacatccccggatgctttatcaacggaacgctcagttcgcgaaacagatcgctggagccaactggacgataactaccatttctggccagggtataaacctgtttatcaccatggagcaggtctacacgaacgatatctgccgacatcattaattcggtaatttgtggccttaatacgctgaagtcattcgacacaaggtgggtatcaatcgccgtcgccaccgcctgaacgcgatgactaaacttatactgaatggcgttgtagaaacttagcgaacagcccagcaaagtcacaaaaattgttaacccggtgagcagcgtaacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgcctgccggagggcgatgtcacggtcgatgttcactggtcgagcctgaactataaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggagcaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggacggggagattgtcgtgacgggtgccagtggtggcgtcggcagtaccgccgtggcgctgctgcataagttgggttatcaggtcgttgccgtttccggtcgcgaaagtacccatgaatatctgaaaagtttaggtgctagccgtgttctccctcgtgatgagtttgccgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagaacgccgcgcacaagcctggcagcgactggtcgccgatttaccggaatcattctatacccaggcggcaaaagagatatctctgtcagaggcaccgaactttgccgaggccatcattaataaccagatccagggtcgcacgctggtgaaggttaactaaccatttagcagggaataataagagagggaactcattttgaaatcattattcaatcggttaacgggaaaagcggttagccggacagctttcgtcgaacaccttggtcaggaagttatacaacatcatccaaactggaaagtcatgatttcgactgaccacaaattgatgcgcattgatactccactaaacagctattattgatacgcctccgtcgcctgttaggtttatgttgctttgcctgggcgacgctacgcttagccccttacttatttctggtaccatggggtgaataatctgattttgtttgactacaaattaatcactcgaacctatttaatgctgagcattgtcaatcggttaattttgcgtgctttagcattcacatctatccagacgatgcagtgaaaattgggtaatccccagcaaccgctgcgtaatgtcgtctatcttgtcgcgatcctggcatccctacattatttgtggtctgtgaagattatctcattgcagcccctcatcttcgcagggctggcttttcagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggcggtgaaacgcctgtcacaatcacactaaacaaagagtacggaacccactcatggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcaccaatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataagactgctaaagcgtcaaaaggccggattttccggccttttttattactggggatcgacaacccccataaggtacaatccccgctttcttcacccatcagggacaaaaaatggacactcgttttgttcaggcccataaagaggcgcgctgggcgctggggctgacccttttgtatctggcagtttggttagtagccgcttacttatctggcgttgcccccggttttaccggctttccgcgctggtttgagatggcctgcatcctgacgccgctgctgtttattggactgtgctgggcgatggtgaaatttatctatcgcgatatcccactggaggatgacgatgcagcttgaagtaattctaccgctggtcgcctatctggtggtggtgttcggtatctcggtttatgcgatgcgtaaacggagcaccggcaccttccttaatgagtatttcctcggcagccgctctatgggcggtattgtgctggcgatgacgctcaccgcgacctatatcagtgccagttcgtttatcggcgggccaggagctgcttataaatacgggctgggctgggtattgctggcgatgattcagcttcctgcagtctggctttcactcggtattctcggcaagaagtttgcgattcttgcgcgccgctacaatgcagtgacgctgaacgatatgctgtttgcccgctaccagagtcgtcttctggtgtggctggcgagtttgagtttgctggttgcgttcgttggtgcgatgaccgtgcagtttatcggcggtgcgcgcctgctggaaaccgcggcgggtattccttatgaaaccgggctgctgatttttggtatcagcattgcgttatataccgcctttggtggctttcgcgccagcgtgctgaacgacaccatgcaagggcttgtgatgctgattggcaccgttgtgctgcttattggcgtagtacatgccgctggcggcttaagtaacgcagtacagaccttgcaaaccatcgatccgcaactggttacgccacaaggcgctgacgatattctgtcgcctgcctttatgacgtcgttctgggtactggtgtgttttggcgtgattggcctgccgcatactgcggtgcgctgtatctcttataaagacagcaaagccgtacatcgggggatcatcatcggtacgattgtggtcgcaattctgatgttcggtatgcacctggccggagcgttaggtcgggcggtgatccccgatctcaccgtaccggacctggtgatcccaacgttaatggtaaaagtgctgccaccgtttgctgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtaattacgttagttctcggcgcgttgctgctgcttgccgcctggaagccgccagaaatgatcatctggctgaatttgttggccttcggtgggctggaagccgttttcctgtggccgctggtgctgggtctttactgggaacgcgccaacgccaaaggcgcgctaagtgcgatgatcgttggcggcgtgctgtatgccgtactcgcgacgctgaatattcagtacctgggcttccaccctatcgtgccctcgttactactaagtttgctggctttcctggtcggaaaccgtttcggtacatccgtcccgcaagctaccgttttgactactgataaataaagagttttgccatgccttggatccaactgaaactgaacaccaccggcgcgaacgcggaagatcttagcgatgcgctgatggaagcgggtgccgtttctatcacttttcaggatacccacgatacgccagtatttgaaccgctgccgggcgaaacgcgcctgtggggcgacaccgatgtgattggtctgttcgacgctgaaaccgatatgaacgacgtggtggcgattctggaaaaccatccgctgctcggcgcaggcttcgcgcataaaatcgaacaactagaagataaagactgggagcgcgaatggatggataatttccacccgatgcgctttggtgaacgactgtggatctgccctagctggcgtgatgtgccggacgaaaacgccgtcaacgtgatgttagatccagggctggcgtttggtacgggtacccatccaaccacctctctgtgcctgcaatggctcgacagcctcgatttaaccggtaaaacagtcatcgactttggctgtggttccggcattctggcgatcgcggcgctgaaactgggtgcagcaaaagccattggtattgatatcgatccgcaggcgattcaggccagccgcgataacgccgaacgtaatggcgtttctgaccgtctggaactctacttaccgaaagatcagccagaagaaatgaaagccgacgtggtggtcgctaacatccttgcaggcccattacgtgaactggcaccgttaatcagcgtcctgccggtttcaggcggtttgctgggcctttccggtattctggcaagccaggcagagagcgtttgtgaagcttatgccgatagcttcgcactggacccggtcgtggaaaaagaagagtggtgccgtattaccggtcgtaagaattaaccttcgcatcgccgtagggtgacgcggggcgaagtgcgagcaagctcacaaaaggcacgtaaatttgccgattatttacgcaaatttgcgtgccaaaattttcattcataaagaaaaattgagaacttactcaaatttctttgagtgtaaattttagtcactattttctaatatgatgatttttatgagtaattatcgcaccacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaagattcgcaccggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggcgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgcgctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccggtttggtaatgaagctaagaccattattcacggtgatgcgcttgccgaacttaaaaagatccccgccgaaagtgtcgatctgatctttgccgacccaccatataacatcggtaaaaattttgatggtctgatcgaagcctggaaagaagatctgtttatcgactggctgtttgaagtgattgcagagtgccaccgcgttctgaaaaagcagggcagcatgtacatcatgaacagtacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacattcaacggtgatgctattctggtagaagccaaaaccggatcgcagcgcgcgttgatcgattatcgcaaaaatcctccacagccttacaatcatcaaaaagtaccgggtaacgtttgggattttccgcgcgtgcgttatttgatggatgaatatgaaaaccacccgacgcaaaaaccggaagccttactgaaacgcattattctcgcctcttccaacccaggcgatatcgttctcgacccgtttgctggtagctttactaccggtgccgtagccatcgccagcggacgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattacaaagtaaaggatgtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttacatgacacttaattcattcgtttgatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgaggttatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaagccgacaatcaatttttcacgcaattgttgaaacgggtcatgctctaatccagccgtcaagtgttcctggattaactcccgcaatgaaggctgttgcaaccacatctcattaaacagttgagtcttgttttcgaagtgccagtagatagcgccacgcgtaacgttagcggcgtcggcaatgtcgttgagcgtcgtcttgcttacgccatgctgcgcaaactgggcgatggcagtttcaatcagttcttgccgggtcttcagagcttcggctttggttctttttgccatgattaattattcaggaaataaatatattcgacacagagtgagaaaatagcgaaggttaatctatcacctaatgtgtatttatacgagaggctaatattgagttgctataaatcgttaaataaataatatatattatttacctaagatacattcactacatcaatatatatttcaatttacgaggttttaattctgcctctttcaacccgcgtcaaaataaaacagtagaatattaatctttttttgtgtttatgtgccttgagatgcctgtattcataactattccttacatcgacgaatgataatttgtaggatagcgaactgtatttttctttctgcgagttaacgcgttgcctttttgggtaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtaaaaacggccccgttagaagttaagactgaattaccaggccgcaccaatgcttatcgtatagccgaagttcgcccacaggttagcgggatcgtactgaatcgcaatttcactgaaggcagcgatgtgcaagcaggccagtccctgtaccagatcgatcccgcgacctatcaggcaaattatgacagcgcgaaaggcgaactggcgaaaagtgaagccgccgccgccatcgcgcatttgacggtaaaacgttacgttccgctcgtgggtacgaaatacatcagccagcaggagtacgaccaggccattgctgatgctcgtcaggccgatgccgccgtgattgccgcaaaagccacagtcgaaagcgctcgcatcaatcttgcttataccaaagtcactgcgccaattagcggacgtatcggcaaatcgactgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggaaaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgtgcacggattgatgaaggcgtccaacctgacgccattcttatcccgcaacaaggcgttagccgcacaccgcgtggtgatgcaaccgtgctgattgttaacgataaaagtcaggttgaagcgcgccctgtcgttgccagtcaggcgattggcgataaatggttgattagtgaaggactgaaatctggcgatcaagtcattgtcagcggcctgcaaaaagcgcgtccgggagagcaggttaaagccactaccgatacccccgcagatactgcatcgaagtaaggtaatctgacatggcaaacttttttattcgacgaccgatatttgcatgggtgctggccattattctgatgatggcgggcgcactggcgatcctacaattgcccgtcgctcagtatccaacaattgcaccgcctgcggtttctgtttcagcaaactatccgggcgctgatgcgcagaccgtgcaggatacggtgacgcaggttatcgaacagaatatgaacggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaggttcagcagcaggggatcagtgttgaaaagtccagtagcagctatttgatggtggcgggctttgtctctgataacccaggcaccacacaggacgatatctcggactatgtggcctctaacgttaaagatacgcttagccgtctgaatggcgtcggtgacgtacagcttttcggcgcacagtatgcgatgcgtatctggctggatgccgatctgctaaacaaatataaactgacaccggttgatgtgattaaccagttgaaggtacagaacgatcagatcgctgccggacagttgggcggaacgccagcgttaccagggcaacaattgaacgcctcgattattgctcagacgcggtttaaaaatccggaagaattcggcaaagtgaccctgcgcgtaaacagtgacggctcggtggtacgcctgaaagatgtcgcacgggttgaacttggcggtgaaaactataacgttatcgctcgtatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcgatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggttggtttaataccaccttcgatcatagcgttaaccactacaccaacagcgtcggcaaaatcctcggatccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagttacggattactatctgaagaacgagaaagcgaacgttgaaagtgtctttacggttaacggctttagcttcagcggccaggcacaaaacgccggtatggccttcgtcagtctgaaaccgtgggaagagcgtaatggtgacgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggccgcgtgaaaaagttgtatgttcaggcggatgccaaattccgtatgctgccagaagatgtcgataaactttatgtccgcagcgccaacggcgaaatggtgccattctcggcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtagtgccgttagggattgtcggcgtgctgctggcggcgacactctttaatcaaaaaaatgacgtctactttatggtgggcttgctaacgacaattggcttgtcggccaaaaacgctattttgatcgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgctgtgggtatcggggtaatgggaggaatggtctctgcaacgttgctggcaatcttcttcgtaccggtgttctttgtggtgatccgccgttgctttaaaggataaatcagaaacataaaggcgctttcgggtgcctttattatttccagtgaaacccataaaaattaataagatattcttctgctcactctttaaaagctttctatagttcccgctcccttcactatttttacaattcacataatttgtcattattcattccgcaagatttataacctccggtgataaaatggcattcagctcgttaataagagagttaacttattaagcgttagcgtttattactgaggtaacaccatgaaaagattaattcctgtggcattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagctgctgttgctggcctgacgatggggatcatcgctctatcgaaataactgaacagggcgcggagttccgcgctctttttaacgatacagtatctctccataagataaaatattgctatattctgctgggtaattccctgctgatttagcatgttacatcgcgttatttcgctgctttcgaaataacgcatcaatttaattttcacacttcccaccagaaatatactcacgctaacaatcattattctgcttagtaaaacacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgctgctggcgcgacgcttgatgccgttcagaaaaaaggttttgtgcaatgcgggatcagtgatggattacctgggttctcttatgccgatgctgacggtaagttttcaggtattgatgttgatatttgtcgtggtgttgccgctgctgtatttggtgacgacacgaaagtgaaatataccccgctcactgcaaaagaacgcttcaccgctttacagtcaggggaggtggatttgctctcccgtaatacgacctggacttcatctcgcgatgccgggatgggaatggcatttaccggcgtcacttattacgacggcattggcttcctgacgcacgataaagcggggctaaaaagcgcgaaagaactggatggcgctaccgtctgtattcaggcgggtactgataccgaactcaacgtcgccgactacttcaaggcaaacaatatgaagtacacaccggtgactttcgatcgctctgacgaatcagcgaaggcactggaatctggtcgctgcgatacgctggcctcggatcaatcacaactgtatgccctgcgcatcaaattaagcaacccagctgaatggattgtcttaccggaagttatctcaaaagaaccgcttggtccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctataacatcatcaaacaggtgggtaactactcggaaatttttgagcgtaacgtaggttcagaaagcccgctgaaaattaaacgtgggcaaaataatctctggaataacggcggtattcagtacgcaccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattgttggttggttatttcacaacactgtaacgaatctcaataatcgtggcattacttcaggttttgcctttctggatcgcggcgctggcttcggtattgtccagcatttgatcgattaccagcagggcgacacctacggacgcgtttttattgtcggcttactcaatacgctactggtttctgcattgtgtattgtgttcgcttctgttttgggcttctttatcggtctggcgagactttcggataactggctgctacgaaagctttccacaatttatattgagatcttccgtaatattcccccgctgctgcaaatcttcttctggtactttgccgtgttgcgcaatttgcccggaccacgccaggctgtgagcgcgtttgatctggcctttttgagcaatcgtgggctttatattccgtcaccgcagctgggagacggatttattgcgtttatcctggctgttgttatggctatagtcctttctgttgggctattccgctttaataaaacataccagataaagaccggacaactgcgccgcacctggccgatcgccgcagtgttgatcattggtttgcctttactggcgcaatggctttttggcgcagcactacactgggatgtcccagccctacgaggctttaacttccgcggcgggatggttttaattcctgaactggcagccttaacgctggcactttcggtttatacatctgcatttatcgccgagattatccgcgctgggatccaggcagtgccttatggtcaacatgaagcggctcggtcactgggattacccaacccggttacgctacgccaggtcattattccccaggcattgcgggtgattattccaccgttaaccagccagtatctcaacatcgtcaaaaactcctctcttgccgccgctattggctatcccgatatggtttcgctgtttgccggcaccgtgctgaatcagacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcccggcgagccataactcaagccgcgcgatggtgtgggtgcgaaaaaatctgttctccagctggagcaatagcctgctgactattggctgcatatggttgatgtgggaactgatcccaccgttgctgaactgggcatttttgcaggctaactgggttggctcaacgcgtgccgactgcacaaaagccggtgcctgttgggtcttcatccacgaacgatttggtcagtttatgtatgggctttacccacacgaccaacgctggcgaattaacctcgcattactgattgggcttgtgtcgatcgcaccaatgttctggaaaatactcccgcatcgcggtcgctatattgcggcctgggcggtgatttacccactgattgtctggtggctgatgtatggcggtttttttgctcttgagcgggttgaaacccggcaatggggcgggctgacgctaactttaattattgcatcagttgggattgcgggggcgctaccgtgggggatcttactggcgttaggtcgccgctcccatatgccgattgtgcgtatcttatcggtcatttttatcgaattctggcgcggcgtgccgctgattaccgttctgtttatgtcttcggtcatgctgccgttgtttatggcagaaggcaccagtatcgacaaattgatccgcgcgctggttggcgtgatcctgtttcagtcagcatatgttgcggaagtcgtgcgaggtggattacaggcgctgcctaaagggcaatatgaagcggcagagtcgctggcgttgggttactggaaaactcaggggctggttattctgccacaggcgttgaagctggtaattcctgggctggtaaataccatcatcgcactcttcaaagataccagcctggtgatcattatcgggttgttcgatcttttcagtagcgttcagcaggcaaccgttgatcccgcctggttgggtatgtcgacggaagggtatgttttcgccgcgctgatctactggatcttctgtttcagcatgtcgcgctatagccagtatctggaaaaacgttttaacaccgggcgtacaccgcattgaggacactatgagccaaattttactgcaacctgctaacgcgatgattacgctggaaaacgtcaataaatggtatggacaattccatgttttgaaaaatataaatttaaccgtgcaaccgggagaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgttttacagaactgtaccctggcaccgatttgggtacgcaagatgcctaagaaagaggctgaagatctggcggtgcattacctagagcgggtgagaattgccgaacatgcgcataagtttcccggacagatttcaggtggtcagcagcaacgcgttgccattgcgcgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtaatttttatggatcgtggggaaatagtggagcaagctgcacctgatgaattttttgcgcatcctaaatcagagcgtacgagggcatttttatcgcaggtaatccattaattgaatgttagttcgaaaagcaaaaaggccatcctttcggatggcctttcgcttgatttgatgtctggcagtttatggcgggcgtcctgcccgccaccctccgggccgttgcttcgcaacgttcaaatccgctcccggcggatttgtcctactcgggagagtgttcaccgacaaacaacagataaaacaaaaggcccagtcttccgactgagccttttgttttatttgatgtctggcagttccctactctcgcatggggagaccccacactaccatcggcgctacggcgtttcacttctgagttcggcatggggtcaggtgggaccaccgcgctactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagcatcacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttctaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcgttgttcagtgtttcaattttcagcttgatccagatttttaaagagcaaaacttcgcagtgaacctttgcaggtacactctgaagtattttttatttaatcactacagagatggtggagctatgcgggatcgaaccgcagacctcctgcgtgcaaagcaggcgctctcccagctgagctatagccccataacatgtagttaaaacctcttcaaatttgccgtgcaaatttggtaggcctgagtggacttgaaccaccgacctcacccttatcaggggtgcgctctaaccacctgagctacaagcctgtagaggttttactgctcattttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgagggtccccctctttggtcttgcgacgttatgcggtattagctaccgtttccagtagttatccccctccatcaggcagtttcccagacattactcacccgtccgccactcgtcagcgaaacagcaagctgtttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagttgcgacgcggctttcagctcactgtcgcgaggtggcgtatattacgctttcctctttcagagtcaaccctgaatttcaggatttttttctcttcgttgttccgaccatcctgtgaagtgtttcacgttgtcgtctcaacggaggcgcattatagggatcccaattttttgcacaagtatttttttgatctttttttctgtttgttgttttttcaccctttttgctgcaatcgcacacaaaacggtgcttttttgcatactaaaagacttgcacaaggccaataatgcccccaaagtcattagtaaatcatttattgctgaggtaagtatgtctgatgttttacgcccataccgcgatctttttccacaaatcggtcagcgcgtaatgatcgacgatagcagtgtcgtgattggtgacgttcgtctggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagtctggtcccacaaaataaacggctggagagcggatatctgtatctcggtagccccgtcaaacagatccgcccgttaagtgatgaagagaaggctgggttacgctattccgcgaataattacgtgaaatggaaggacgaatatctggatcagggtaaccagacccagccttgatcatcttcactttgttcctgaattaagttttccgcttcttcttccaggtcccagcgatgctgacgaaaactcgctaaccactgttctggcgtatctccagtaaagcgatacgccagactctcgccagagatcgcgcatgtcagttgcataccattcacgagagcgggaaaacatacacattttttattctcgtcccactcttccctgtccggaaactggatggcctgattcacgcggacaattcctcctgcaattgctttataactggttctacgtcaggcagaacaccgtgccagagaagaaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatactcaacgcctgaatactgccagtgtgcgcaaacaatttagccaactcttccgcgcgggataccgtccgattagttattgtcaccgcacagtccagggaaaggagtggcagtagtacgccgcgagatgctccaccagcgccgataagcagaatacgtaaaccagggcggataaaagacagacgttccagatcgcttaacaagcctacaccatcggtattgtcacccagcaggcgtccatcttctaaccgcatgagggtattaacagcaccagccaacgctgcccgttcagtaagctcatccgctctggcaaaagcctcttctttaaaaggcaccgtcacattcgcacctttaccaccagcactaaagaaagcgttcagtgtgttgatgaaatcattgatgggtgccaacacgcgcccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaagacaaaggtgacaggacctggccagcgggaaaaaatggtttcacgctgcacgtcagtcaacatggtgtcatcaatatagggtttaagctgctcgtaatttgctgcgattaaaatcagccccttatcaaccggacgctgttttaactccaacagtcgcatcactgctgtttcgctatcaggatcgcacccaacaccgaaaacggcttccgttggataggcgatgacacgttcttcattgagaacatctatcgcagctgcgatagcgtctctttgcaggttattattcacgttattattccgccgaaaccggctttccacattgtttactggcacaaaagtgttttacaccctgcgcggttttcttttcgatgagtagcggataatgacactcagggcattctccagctatgggtttgaagttaatggcaaattgacactccgggtagcgatcacaagagtgaaatgttttgccataacgggagcggcgctggaccagatggcccgtccgacattgggggcatgtaattgctgtttcgtccggtttatcgataagttcggtatgttcgcattcagggtagttaatgcaaccaataaacataccaaagcgtccctggcgtaataccagatttgcgccacatgcagggcaaacctgcccctccagaactttgacgatatgtccatccgctgaagatttcagaggacggacgtagtcacacgccggatactgtgagcatccaagaaacggaccgtgtttcccggatcgaataaccagttcagccccgcactttgggcaggactcattattacgcaccgtgaacagtgctgatttcgccataacaacttatgctgaattaaagaaatgattaatgcagcataccttcattcacttcaaagagtaattcttccatttgctggtacgcattttcgcagcccggaatattgaacaacaccatcaggatcacccatttcagatcatccagttcgaactctgcgttatccagcgcgagcactcgctctatcaccatttcacgagtttcaaggttgagcacctgaatctgctcaaggaaaagcagaaacccacggcagctggcatccagtcgttcacactcttccggtgtataaatacgcatggagagaggatccgaggccagttgcatcggttctgccaacccttcctgataatcagcaagtttttccagccatagcagggcattgtagatatcttctcgctcaaaacctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttgctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaggcaaaaacttctcgcccctgctcaagcgcacaacgtgctgtcaccagcgaaccactacgcaaagccgcttccaccaccagtacacctttacttagaccactgataatgcgatttcttcgtgggaaattgtaagcaaggggtggaacatcgaggggaaattccgagacgagagcgcccccctgttcaagcagactggcagccagtcgggcatgacggcggggatgaatggtattaagtccattccccaatacagcaatgctgacgccatttacctgtaaggctgctttatgcgctacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcagcgcgtgcagttctccttcaacaaacagtgcgccggggtaatctgtcgtcgccagaagttgaggaggataaaattcgctgtccgcaggaattaaatgatggttgggttgctccaaccaacaaagtgagctttcgatactctttcgtggaaatgaaagaaagcgttgtgcctgccgcaatgtaagccctgtttgctgcaatacaaccgcatcaatatgcgactgttttgccacccagtgagcgatacggaccatatcatcgccgtacaagctgctgatactcattaaacgcagccaaatttctgtatcgaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgttattgatgtttcggaaaaccgtgacgaacggctagtgttaatcaatccagagcttttagaaaaaagcggcgaaacaggcattgaagaaggttgcctgtcgatccctgaacaacgtgctttagtgccgcgcgcagagaaagttaaaattcgcgcccttgaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaactaacgtgtcagaatcactacgtattatttttgcgggtacacctgactttgcagcgcgtcatctcgacgcgctgttgtcttctggtcataacgtcgttggcgtgttcacccagccagaccgaccggcaggacgcggtaaaaaactgatgcccagcccggttaaagttctggctgaggaaaaaggtctgcccgtttttcaacctgtttccctgcgtccacaagaaaaccagcaactggtcgccgaactgcaggctgatgttatggtcgtcgtcgcctatggtttaattctgccgaaagcagtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgtcggtttagacaccggtgatatgctctataagctctcctgcccgattactgcagaagataccagtggtacgctgtacgacaagctggcagagcttggcccacaagggcttatcaccacgttgaaacaactggcagacggcacggcgaaaccagaagttcaggacgaaactcttgtcacttacgccgagaagttgagtaaagaagaagcgcgtattgactggtcactttcggcagcacagcttgaacgctgcattcgcgctttcaatccatggccaatgagctggctggaaattgaaggacagccggttaaagtctggaaagcatcggtcattgatacggcaaccaacgctgcaccaggaacgatccttgaagccaacaaacaaggcattcaggttgcgactggtgatggcatcctgaacctgctctcgttacaacctgcgggtaagaaagcgatgagcgcgcaagacctcctgaactctcgtcgggaatggtttgttccgggcaaccgtctggtctgatagtccactcttctaagcccggtcttgccgggcgtttttatacttatgaaaaaacaacgtaatttacgtagcatggcggcccaggccgttgaacaagtcgtcgagcaagggcaatcattaagcaacattctgccaccgctccagcaaaaagtttccgataaagacaaagcacttcttcaagagttgtgctttggcgtactgcgtacgctttcgcagttagactggctgattaataagttaatggcccgtccgatgaccggcaaacagcggaccgtgcattacctgattatggttggtttgtatcaactgctttatacccgcattccacctcatgctgcgctggctgaaacggttgaaggcgctatcgcaattaagcgtccgcaacttaaagggttgataaacggtgtattacgccagttccagcgtcagcaagaagagttattagccgagtttaatgccagtgatgcacgttatctgcatccttcctggttgctgaagcgtctgcaaaaagcgtatccagagcagtggcaatccatcgtcgaagccaataaccagcgtccgccaatgtggctgcgtattaatcgtacgcatcattcccgcgacagctggcttgcattgctggatgaagcaggaatgaaaggtttcccgcatgcggattaccctgatgctgtacgtctggaaacacctgcacctgttcatgcgctacctggttttgaagacggatgggttaccgttcaggatgcatcagcacaaggttgcatgacctggcttgcgccacaaaacggtgaacacattttggatctttgtgccgcccccggcggtaaaacaacgcatatccttgaggtggcaccagaagcgcaggttgttgcggttgatatcgacgaacagcgcctctctcgggtttacgacaatttaaaacgccttggtatgaaggcgaccgtgaaacaaggtgatggccgttacccttctcaatggtgtggcgagcaacagtttgatcgcattttattagatgcgccttgttcagcaaccggtgtgattcgtcgccatccagatattaaatggttacgtcgcgatcgcgatatcccggaactcgcgcaattgcagtctgaaattctcgacgccatttggccgcatttaaaaaccggtggaactctggtctatgccacctgttcggtgttaccggaagagaatagcctgcagattaaagcctttttgcaacgtaccgctgatgccgaactttgcgaaacaggaacaccagagcaaccgggtaaacaaaatctacctggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgggtcgtgcaggggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgtgccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttacagaatacgatcgtcttttttggtgatgcgtcggatcaagaactactggccgaagaacatatcgatcaagttgatctgtttattgccgtcaccaacgatgacgaggccaatatcatgtccgccatgcttgccaaacgtatgggtgcgaaaaaggtgatggtattgatccagcgtcgcgcttatgtggatctggttcaggggagcgttatcgatattgcgatttcaccacaacaagcaactatttctgcgttgcttagccatgtgcgaaaagcagatattgttggtgtttcctcattgcgccgcggcgtagcagaagctattgaagccgttgctcacggtgatgaaagcacctcacgcgttgtcggcagagtcattgacgaaatcaagctaccgccaggaacgattattggagcggtggtacgtggaaacgacgtgatgattgccaatgacaatctgcgcattgagcaaggcgatcacgtaattatgttcctcacagataaaaagtttattaccgacgtcgaaagactcttccagccaagccctttcttcttgtaattaataaggcgtctaatgacgccttattatttccctttgattatcaaggattaattaaattcattcctggcaggaaaatggcttaacatttgttagacttatggttgtcggcttcatagggagaataacatgagcattattaaagaatttcgcgaatttgcgatgcgcgggaacgtggtggatttggcggtgggtgtcattatcggtgcggcattcgggaagattgtctcttcactggttgccgatatcatcatgcctcctctgggcttattaattggcgggatcgattttaaacagtttgctgtcacgctacgcgatgcgcagggggatatccctgctgttgtgatgcattacggtgtcttcattcaaaacgtctttgattttctgattgtggcctttgccatctttatggcgattaagctaatcaacaaactgaatcggaaaaaagaagaaccagcagccgcacctgcaccaactaaagaagaagtattactgacagaaattcgtgatttgctgaaagagcagaataaccgctcttaacaagcgcctgaaagcagaagaccagtggtaaaaaagtgatttactttcttgccactggcctcccagttcccccgattgccatgttttccttttcgcatgtaactgcctttccccttcttatttttctctacgcgctgtcggaataagggatcatgtagtaatgcttctatcgcattatcctttatctgccctttagtatgctgatatcgactcataaaaactccagttggttatttaacggcgcgagtgtaatcctgccagtgcaaaaaatcaacaaccactcttaacgccactcgccccttgttcaagagcttcaagaatcgaacaataaacactgctatgagcagtcccacaacaggcatcgttaaggcgttgcaaggaacgctgcatactctgcaactcggctatccgtgcttcgacttcctgcaatctttcctgcacaatgccttttgactcctgacaggtatggtgttcaggatcgatgcggatcgacagcaactcgcggatcgactccagactgaaacctagttgtctggcatggcggataaatttcaatcgctggagatcgctttcggtatataggcgaaacccaccttcagtacgcacttcatgctccatcatctgctgtttttcgtaataacgaatcgtgtcgggtgttacttccgccatttttgccagctcaccaatgcgatacatacatactccactagttatcgttgattttgtccaacaacttgtcagcataatcgccgcgtaaaaaatcggtactcaatccagcttgtcgcagcttcaattccagtaatgacaatcgacggctaacctcttgatattgcggatcatcgtgacggatacctttgagaatatccagaagctgaattgcttctctccgttgctcaagttctggcggtaagcaaccggcattcttcagcaagcgataccccgcacgtaattccggtggcacgtgagaatcatcatccagtatcaatggttcgccgctacctgccaggttatcaaactcacctttcgcttgcgcttctgctatatggcgctctgcccactggtcaagtaaccacataaatactccaggggatgaacaaaaagagtacagctattgtagataagtggggatactacgggtataaaaaaacccgccggggcgggtttttttacgttgcttcagattactctgcagcagcttctgctttctctgaacgatcaaccagctcgatgtaagccatcggcgcgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgagctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatatacagcgcaccaaccagggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcaggtcgccttgacgcgcttgctcgatagtatgggcaatggctggcgggagtcccgcgacaataccggcgaagataatgattgaaataccgttgccgatacctcgttcagtaatctgttcgcccaaccacatcaggaacatggttcctgtgaccagacttacaacagcggtgaagtagaatgcaaagcccgggttaatcaccaggccttgcataccaggcatattcggcagaccggtagcaataccgatcgactggaatattgccagcaccagagtaccgtagcgggtgtactggctgatcttacgacgaccagactccccttctttcttaatttctgccaacgttgggtgaaccaccgtcagcagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctactacaccgccttctactttagccaggtcagacagacgaatttcggctgtaatcgctgctttacgagaagtgaagccgaatttcggcagacgacggtacagaggcatctgaccaccctcgaaaccgcgacgtacgccaccgccagaacgagacttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcaatagttgcacgaaccacgttgatcgggttggtggaaccataggctttagccagaacgttatgaaccccagcgacttccagaacggcgcgcattgcaccaccggcgatgataccggtaccttcggaagccggctgcatgaatacgcgagaacccgtgtgaacacctttaacagggtgttgcagagtgccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgccgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtattgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgggcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttttcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttggcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagccttcgggttatctctcaagttcgttcagtgcatttttgacacgctctcttaaaccggctttctcttcgctttcttccacagtattttcttcgtcttcagaagaagagggggcattctcaaccgcgacgcctgggtcatcttcctcctcgacggattcgacgacggggagtggctgttttttgaagaaatagtgttgtgttgattgtttaaaagcgggcgtttcagcctctacagtgacttcggcttttactatccaaagcacccatagctgcctggcatacccaccaaccagcaccattcctgcaaaccacaggcaaatcagtaataaacaaattacatatattatggtgctgtgtttttgtcgggagaagataccagggtgacctgtttctttctgctcacgcgcggcgatatagaattcaaacatgtcatttccccttcactgttgtttccggggaaatatttgcttcatcccgatataagtaggcactctcccctgccacctgccagagatgtactaacgttgaaaagccaacaacaccgtcagttttcaagtggtggcttttttgaaattgctttattttttctaccaacaagggacgccactccgccgaaggttctgtcgaaatatgcaatgcgcggtttaacatcgtttccagccagagaatctcttcctcgctgctatcacgcgtaatggtactctccccttccggcgacattttccacaacagaagataatcacccgtccataccgactcaaaccatttatgtgtcagcgtccacgtttgctgacctacgaggacatcaacgctagcctcaccgacgcgaacgaccacaacaggcaattttttgtccccgactttaagcgatgcgatccagggcaaattctgatctaccaatgtttgtaaagaagcattcccacttttacatgccagccccgctcttactgcctgatcgcaccaggccgaatcagctgggacctcgtacccccatacgccgtataacacgcttagcgcctcactatcgcgcatcaccacatgagcaatatccttagtcatatcttgtttaactactggcgttacgggtatcagccacgcaggaacgggtaacgtagctgtaaaagaggacagcagtagccaaccacaggtaagagcgataatggttccactcatcaccacggcaagctgcattttccgggggcggttatcacccaatatgcggtaaatcattcgccattgttttgctgtgaaaacgctggtctgctcggcttgctgtaataagcgaattgtttcgccggcaagcgccagctttctgcgatcgccccgacataataaagctatccgtttcagaactctggcggttaaaaggagatcgggttggtcaatattctgaccttcaaggatgcttgccttaagttcgtgctccgtcagacgtcctatcgagacaagttcaatgccctgttttttaaaatcacgttcgacttttcgatcgggtctgccgatcagcaaaaattgaccgtcaggaataagagatattgcgcgttggagatcatcaagtatgcggcggtgattcaggtgagcattttcaataataataagagggcagcgactatcagttcgatgaagcgcatgcagtaattgccccgccatctcatctcgcgtccaggcgctgtcacggcagccctgttcagccgcgttatcgtcggtaacgatccatgcggccttaccttgccaggaaacaacgaggcttaaagtaatcacacggcgatgtttatctttttgcagttgctgcgccagccaggtttttccacttccagcctcacccaacaaatagcatagacgccaggtttgacgtttctcacacaaccaggaaagaataacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacgtttccccttccatctggcgaatcataataaagatgctgccatcaatatattgattatatttataagcatagggtcgattatttttaatgtgaattatttccatacaactatagttaaaaatggacagatcattaatcaaccaacaaacgcatttcagtctgatttcagccttgccgctttatggcgtaacgaaaatcatgctggggtaaaagatgcaaatcccgtggcagttaatcaggaaacacctaagctctctatagcgcttaatggcattgtactcacatcgaatgatgagacttcttttgtcttaattaatgaggggagcgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcagaaagtcaaaatgtactcgctgattatattatcgccacgcctatacgtgatggagaacagatatacgggcttcgattgaaccctcgtaagggcctcaatgcatttaccaccagcttgctacaaccaggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcggggaacttacaggaatgaatggactgcgtcatgaaaggactcaataaaatcacctgctgcttgctggcagcactactcatgccttgtgcaggacacgctgagaacgaacaatacggcgcgaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacgctggacaatggttttctgaaagtggttcgctcagctaatgtaaaaacatcgccagggatgattgctgacagttctcgtccaggcgtaggtgatgagttggtcacccgaattgtaccgcttgagaacgttcctgctcgtgacctggcccccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcgtcagcggaagatctcgccgagattcttaatcaattaatcagcgaaagccacggtaaaagccagatgccagccctcctctccgcgaagattgtggcggataagcgaaccaactctcttatcatcagtggaccggaaaaagcacgccagcgcatcacttcattactgaaaagccttgatgtcgaagagagcgaggaaggaaatacccgggtttattacctgaaatatgctaaagccacgaatctggtggaagtgctaaccggtgtttccgaaaagctgaaagatgaaaaagggaatgcgcgtaagccctcctcttctggcgcgatggataacgtcgccattaccgccgatgaacagactaactctctggtcattaccgctgaccagtccgtccaggaaaaactcgccacggtaattgcgcgtctggacattcgccgtgcacaggtgctggttgaggcaatcatcgttgaagttcaggatggaaatggactaaacctcggcgtgcaatgggcgaataaaaacgttggcgcacagcaatttaccaataccggattaccgatttttaacgctgcgcaaggtgtggctgattataaaaagaatggtgggatcaccagcgcgaatcctgcctgggatatgtttagcgcctacaatggcatggccgcaggcttcttcaatggcgactggggagtactgcttaccgcgctggccagtaacaataaaaatgacatcctcgccaccccaagcatcgtaacgctggataataaactcgcgtccttcaacgtggggcaggatgtgccggtgctatccgggtcacagaccacttcaggggataacgtctttaataccgtcgaacgcaaaacggtggggacaaaactcaaagttactccgcaggtcaatgaaggcgacgcggtgttgctcgaaatagagcaggaagtctccagcgttgactcttcctctaactcgacgctcggcccgacgtttaatacccgtactattcaaaacgccgtgctggtcaaaaccggtgaaacggtggtcctgggcggattgctggatgatttttctaaagagcaagtgtcaaaggttcctctgcttggcgatattcctttagtggggcaactcttccgctatacctccaccgagcgcgctaaacgcaacctgatggtatttatccgtccgacgattatccgtgacgatgatgtttatcgctcactgtcaaaagagaaatacacccgttaccgtcaggagcaacaacagcggatcgacgggaaatcaaaagcgctggttggctcggaagatttgccggtgctggatgaaaacacgttcaacagtcacgcccctgcgccatcgtcacggtgaggcattcatatgagaattcactcaccgtaccccgccagttgggcgctggcacaacgaattggttatctctattcagagggcgagattatttatctcgccgatacgccattcgagcggttactcgatattcaacgtcaggttggccagtgccagaccatgaccagcttgtcacaggctgattttgaagctcggctggaagcggtattccatcagaataccggtgagtcgcaacagattgcgcaggatatcgatcaatccgtcgatcttctctcgctttcggaagagatgcccgcaaatgaagatctcctgaatgaagattcagcggcaccggttatccgcttgatcaatgcgattttgagtgaggccatcaaagaaaccgcctctgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggaagaattagtttgcgtatcgggcgacgtaacatagatgtccgcgtatccacactgccgtccatctatggtgaacgcgccgtactccgcctgctggataaaaacagcctccagctttcattgaacaacctggggatgacggcagcggataagcaggatttagaaaatctcattcagcttccgcacggtattatcctggtgacagggccgacaggctccggtaaaagcaccacgctctacgccatcctttcggcgctgaatactcccggccgcaatattctgacggtagaagatcccgtggaatatgagctggaaggcattgggcaaacgcaggtgaatacccgtgtggatatgtctttcgctcgcggcctgcgcgccatacttcgccaggacccggatgtcgtcatggtgggggaaattcgtgatacagaaaccgcgcagattgcggttcaggcctcgctcaccggccatctggtactctcaacactccacactaacagtgcatcaggcgcagtgacccggctccgcgacatgggcgtcgaatcattcctgctttcgtcttccctggcagggattatcgcgcaacgtctggttcgtcgcctgtgtccgcaatgccgacaattcacgcccgtatcaccccaacaagcgcagatgtttaaatatcatcagctcgcggtgacaacaattggcactcccgtaggctgccctcattgccatcaatccggctatcaggggcgcatggcgatccacgaaatgatggtggtgacgccggaattacgggccgctattcatgaaaatgtggatgaacaagcactggagcgactagtccggcaacaacacaaggccttaatcaaaaatggcctgcaaaaagtgataagcggtgacacctcctgggatgaggttatgcgcgtcgccagtgccacgctggagagcgaagcatgaattatcgctatcgcgccatgacccaggatggtcaaaaattgcaagggatcattgatgctaacgatgaacgtcaggcacgactgcggctgcgtgaagaagggcttttcctgctggatattcgcccccaaaaaagttcgggagtaaaaacacgtcgcccgaggatcagccatagtgaactgacgcttttcacccggcagttggcaaccttaagcgcagcggcattacccctggaagagagccttgccgtaatcggtcaacaaagcagtaataaacgactgggtgacgtgttaaatcaggtacgcagcgccatccttgaagggcatcccctttccgatgcattacagcattttcccacgcttttcgattcgctctatcgtaccctggtaaaagcgggcgaaaagagcgggctgctggccccggtgttggaaaagctggctgattacaatgaaaaccggcagaaaatccgcagcaagctcattcagtcactgatctacccctgtatgctcactacggtggcgattggggtcgtgattattctcctcactgctgtcgtgcccaaaattaccgaacagttcgtgcatatgaagcagcaactgccgctgagtacacgcattcttttaggtctgagcgacacgttgcaacgtaccggcccgacattattagcgacagtgtttattgtcgctgtaggtttctggctctggttaaaacgcggcaataaccgccaccgttttcatgccatgttgctgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgtctggcaaatgcggcagagaacgttcgccagggtaacagcattcatctttcgctggaacaaaccgcaattttcccgccgatgatgctctacatggtggcctctggcgaaaaaagcgggcagctcggcacattaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaagcatatgcgcgcaacggataagcaacgcggttttacattactggaaattatggtggtgatcgtcattatcggcgtacttgccagcctggtggttcctaacctaatgggcaataaagaaaaggcggataagcaaaaagccgtcagcgatattgtggcgctggaaaacgcccttgatatgtacaaactcgacaatcatcactatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgaacatggtgcatacgatctgctttcagcagggcccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagcgtggtgctcttcacatatggccgggaggatgtcgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagccaaaatgactgggatgaagaactctcaattcatcttcagccatttaaacctgatgacagcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctcctgcaactggtcgcccggaggaatcggagtacggacaaaatcatggtgttgggtgaagaagctatttttaccacgcaaagtcgcgatccgctggctcctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggggaaagccaggaacttcctctctcagtcacgttacatctgcagactcagcaatatggggggttacagcgccgttttgcattacctgagcagttagcgagagaagagtcgccagctcagacgcaggccgggaataataaccatgaataatgaacaacgcggcgtcgcgctgctcattgtactcatgttactggcgctcatggctgctctggcagcagacatgacgctcagttttcacagccagcttcagcgaacccgccaggtaaaccatcatctgcaacggcaatatgatattgaactggcggagaaacttgcgcttgccagcctcacccaggacgttaaagataacgacagacagaccacgttgcagcagtactgggcacagccacaacagttgcagctggaagatggcaatacagtgaagtggcagttacgcgatgcccagcactgttttaatctcaatgcgttagcaaaaatctctgacgacccgctggcttcccctgatttccccgcccaggtattcagtgcgctgctgattaacgccggtatcgatcgcggaaacaccgatgagatcgtgcaatcaatcgctgactatattgatgtcgatgactcaccacgctttcacggcgcagaagatagcttttaccaaagccagacgccgccccggcatagtgccaatcagatgctttttctgactggcgaattacgtcagataaaaggcataaccgaaaacatctatcagcggcttatcccgtatgtctgcgttctcccgaccacggaacttagcatcaatcttaatatgctaacggagaacgatattccgctcttcagagcgttattcctcaataacatcacggatgctgacgctcgggtcttattgcaaaaaaggccgagggaaggctggctaaccacggatgcatttctttactgggcgcagcaggatttctccggtgtgaagccactggttgctcaggtgaaaaggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtcatacgttcttcctcgacgctgcgtaagcattgggaatggatgacgttctccgcagatagcgtatcttcggtacatacgctcacggacgatcttccgctggagtcgctggccgatcagcccggtgccggaaatgttcatcttttgatcccaccagagggccttttatatcgttccctcacgctgcccaacgccaaatacaaactcaccgcacaaacattacaatggctggcagaggagacgttacccgacaacacccaggactggcactggacggttgtcgataaacaaaacgaaagtgtcgaggtgataggcattcagtcggagaaactcagtcgctatcttgagcgtttacatactgccggactcaacgtgacgcgggttttgccagatggctgctatcttccctgggaagtagatagctggactctggttaaccagcaaacaagctggctcattcgcagtgccgcacatgccttcaacgaactggatgaacactggttacagcatcttgctgcccagtttccgcctgagaatatgctttgttatggtgtagtacctcacggcgttgcagcggccaatccacttatccagcatcctgaaataccatcactgagtttgtattctgccgatattgcattccagcgctatgacatgctgcatggtatttttcgtaaacagaaaactgtaagcaaatcgggaaaatggctcgcccgcctggcagtaagctgtctcgttctcgccattctttcttttgttggcagccggagcatcgcgctctggcatacgcttaagattgaagatcaacttcagcaacaacagcaagaaacctggcaacgttatttcccgcagatcaaacgcacccacaattttcgtttttactttaagcagcaactcgctcagcaatatcctgaagctgtgccgttgctctatcatttacaaacacttctgctggaacaccctgaactgcagttaatggaggcgaactatagccagaagcaaaagtcgctgaccttaaaaatgagtgctaagagtgaagctaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcactggcggttctctcgctcggcgttttttgttggcttggggtgataaaaccgatagatacctacattgcagagcatcagtcccacgcgcaaaaaattaagaaggacatcaaatggatgcaggatcaagcgagcacccatggtttactcggtcatcctgcgcttacgcagcccatcaaaaatatccttctcgaggaagcaaaacgtgagaatttggctatcacgctggaaaacggcccggacaatactctgacaattcatcctgtcacagctcccctcgaaaacgtctcccgctggctcactacggcacaggtaacatacggtattgttattgaagaccttcagtttactcttgccggaaacgaagagatcaccctcaggcatttgtccttcagggagcaacaataatgacaatgctactgccgctcttcattctggttggttttattgcagattattttgttaatgccatcgcctatcacctctcgccgttggaggataaaacggcgttaacgtttcgccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaaccgggagggttctccctcccgacacggctcaaccttcttcgcggatctgtgcttgcagataattttgcaggcccatcttctgaatcagatcaagttccgtttccagccagtcgatatggccttcttcatcacgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaggtcctgtaagtttggaagaccttccagaaaaagaatgcgctcaatataacgatcggcgtgtttcatctcatcaatggattcatgatactccacatcattgagacgtttgagaccccagtttttaaacattcgggcatggagaaagtactgattgattgcgacaagctcatttcccaacagtttgttgagataatttataactttagtatcacctttcattttttgactccttcgcttccactctttgaagagtagaacggcttacgagtaagtcaaaaaacacactccgtttatgcggactccttaaactccggcagctgcattaattcatcctccatcacttcacgcgcggcccggacacatttaccgcactgattgccgaccggaataaatttttttaattgctggaacgagtgaggggaaaactggcgcacagcctgacgaatttttttatcgctgataccattacaaagacaaacgtacatagagactcccgtatactttcttcaaaaataaatgaaaatagttcttatttcaattacggaaagactcttttttaagcaaagaatagaaatatgaataaaaataatgggctaccaaaagtagcccattgacaaaaaatgcggcgatactggaaggtatcgccaacacatttattgcttagtaaacggcgcgaagatttcgctaaatgcgtacttcggtgcctgttctttagtcaggccgtggaattccggagacaggttagtgccgcccggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttattgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggccagtcggcagaattggcaaggtgtaccagatagcaatatctttgccttctgacttccatttatcctgcactttcttcacagcaaggttacgacgttcaatagatgcctgatccgcaacccaggtgccttcgatatcgaagtccaggactttgaggttcaggttatcaacgatgtcataataatgctgcatcagatcgtctacgttcttacaggaagcagccagcggagcgttgttagcaccaccgatagacagcatcacatcgccgccagcctcacgcagagctttgattttgctgtactgagcgtaattctgcataccgtaagcggtaccccatgtcggcagacaggtgttcgcatctttactcaccacaaacgccagcgtgaagtggttgacgttatgattcttagccagcgcagccagatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttcacaccgttaaagcgaatcagcgtatcgctggcataaagcgtttctggattaaactgcggcgcattattcagctcttcgttgctatagctctgagccttacctaacggcttccacgggcggctattgctaccggtggcgttttggttcgccaccagagcagggttgtcactttgcgtccagaacagcgcttcataagcctgcccatcaacaacaacgcgatcacctttcacgtacacagtggatgcggaccatgctttcgccggttcgtatttcttccacgggttatcgccgcccgggacaaagccccatgcgtcttgatcgacagaagttttataatgtgcatcgttataatctacgatgctgtccgcgctgtacgctttgctggcctggaaaccatccgcaacaatgacgccgccgttatcaatttcacaggtagtcgggttaccgtactgactcaattccgcagcggtagctgtacgctcgagacgccatgggttattggagttttcagcgctggtaccccgtgggcaatctttagacccaacccaccaggcgttcttgtaaacattaccattgaaaataacatggtaaatttcgctaccttcctggccgctccacgcttgcaatgagtaatcgttaacgctatccgctggtgttgatggctcgctgttatccggagttggggtcaccggtgtttccggagttggatcaaccggagtcacagcaccgccattattatccggcttaacggaacaggagccagggttaccatactggctgatttctgttgccgttgccgcgcgaacataacgccatgggttactggcatcgttttctttcgcatcgcctgggcaatttgccgcgcctacccaccaggcgttcttataaatgccgccgttatagataacgtaccatgtagaagaaccttcctgacctttccaggctactacagcatagttgtcgtttgacttatcagctggggctggctgaacatcaggagccggtttaacgtccggtgccggtttcacatccggtgaaggctgtggtgctgaagtacaggactgtggattactggtttctgagatttccgttgccgtagcggcacgaacataacgccatgggttgctggcatcattgcttttcgcatcacccggacagttagaagaggctacccaccaggcatttttatataccgcaccattaaagacgacataccaggtctgaccgccctgctgtttattccaggcaactacagaagaattagacggaacagtgccctgtgctggtgtagccgaaccgccattagccggcgtattggatgcaggcgtatttgaatttgaagaagatgagctgccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtgacgtaaaaactgcaaaacaaaagtcctacgcaggaattatttacgttttacgagaacccttcaatatgaattaaattacggcattaaaaataagaaaaaagcctgacaaatgaagcattttaaaaacagaaacattcatatttaaaatgttaaattgaattgatattttaaatatgaataatttattcgttctgacagtacgaataagatatgccgtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttggtgtgcggcttgatggtgcccggcttagccagtacctgaccacgttcgatttcttcacgtttgataccacgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatataagaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgtgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcacgacctttggtcagagaacgcagctgagttgcgtatccgaacatttcagacagcggtacttcagcgtggatcttaacgccagtaacttcagattcctgacctttgagcataccacgacgacggctcaagtcaccgataacgtcaccggtgttctcttccggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtaaacacggaagaaggtcaggttaccaacaaacgggtcggtagcgattttgaacgccagtgcagagaacggctcgtcatcacttgcgtgacgttcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatgcgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggataaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggggtgcttaaccgtaagtctgacgaaatcagtatagtcaatgagaatgatgtcgttcgaaatttgaccagtcaaaccgcgggcaataaggtcttcgttcagggcatagaccttaatgggggcattacgcagactttcaaggtagcggttaccgtcaactgcggcagttacgccatcttgcaataatagcagttcgtctccttcactgagcagacgcagcagcgcagcaaaatccgtcagccagggtgagcgatgtaatgtgtgcagcataaacgcctcaaaacctcaaaataacatcgtagttggcgagttcgcggcgtaaggcatctgcttcgagcggcgtggcttcgacaacaaagggtgtctgcggatctaacccgcgttcgcgcagtgaagccgcacaaacccagcactgttcaatgtcgtacagacccaacaatttaaaagtggcaatgtaatcacgcgccagcactgcatcgggcttttgtcctggcagcagctgaaaaacgccatcagctataaagaagacagccagatcgtcagttaatgcggaagttgccagtaaagcatctaaaccttcccggcctgcggctgtaccatgaggtgcagtagaaaaaacaaacgcaattcgtttcatcagaactgtaccaccctgtcacaggtcagcgaggcttccgccagcgccccaagtccgcttaaggtaaatccctgctgaaggtttgacgaagccagccccagtcttccggcctccgtttcatcaacaacgccacggcgtaatgctgccgctacgcagatattcagcgccacaccatgttgcgcattcagttgttgccaggcccgtacgaggtcaaattcgtcacttgccggagaggtcaattggttagcgttatagaccccttcccgatagaaaaagacgctgcttaactcatggccatctgctatcagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcatctttaatatcgaagatccctttctcgtagagattcagcacgatctgacgatttttggcgttattagaaacattgcgatcggcattcacttcttcgatggtgaactccagcgtttgggtaaccagatcttcaacagaagaggcaaagttgacgcttgaaccgacatccggggtttctggcggcacaaaggtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcgaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttaatgcttattttttagcagaatctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagaaagcggttcaccacgggtgtaagagttgtcgaactctttaccgtcgatcagcgtacctttgtagttcactacaacagtatcgctgtctttcggtgcttcgcctttaccggcttctactacctgataaaccagaccagttgaagaggttttcacacctttctctttggcaaatttctcgcggtactctttaccttttgcttcgttatcagccgcgtctttttccatcttcgcctgagcagaagacttcacgcgagcttcgaatgcttgtagagtctgttcgatctcttggtcggagagtttgctcttatcagcaaatgcatcctgaacaccagcgatcagctgatctttatccagtttgatgcccagtttttcttgttcttttagagagttttccatgtaacgacccagcgaggcacccagtgcataagctgatttctgatcgtcatttttgaacgctgctttgctgtcagcagctgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgccaccgccacattattgaggcgtaaaaaaagcggggattccccgcttttttgtcactttttcggtattagtggcaaccgcaaccgccgttgcctttaccgccacagcagccttcgccaccgtgttcatgaccgtgatcgtggccatgaccgccgcagcaaccgtcgtggtcgtgatcgtggtggtgatcgtgcgcgccgtgaacgtgaccatgagccagttcttcttcagtcgcttcgcgaatcgccacaacttcaacgttgaatttcaggttctgaccggccagcatgtggttaccatcaaccacgacgtgatcgtcttcaaccgcagtgatttcaaccggtaccggaccctggtcggtttcagccaggaaacgcatacctacctgcagttcatcaacgcccataaatacgtctttaggaacacgttgcaccaggttttcgtcgtactgaccgtaagcgtcgttcgcgccaacagcgacatcaaatttgtcgccaacttcatgaccttccagcgccgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcgaacgtgatcgcgggcttctttgtctgcttctcgcatctgatgtccgcacttaacacattcaacaatatcaatattattttcgcgccacatcgccattgaatcctgcgcctgacaggccgggcattttgcgcccgcaataaaacgttttcggattgccatctttaccctctactcaaattcatcccagccgtccagctggcgtcgttcttgttgcatttcacgctggaaaatctcttccagttcgcgtcgggcttccctggcgcgagaaatttgtacggtatcggcatgcattgggatgagctctcgcagcatccgcatatccaggcggcgaaaatgcagttgcgctcgctgtgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgttggcatatttccaccagcttcatggtgtcttccggctcgttacaggtaatgacgatagactcagcggcctctgcacccgcagaacgtaaaagatcgacctgcgtggcgtcgccgtaataaactttgtagccgtatttacgcatcaggttaacggcgctgatatcccgctccagcacggtaatgcgcattttatttgccatcagcaaacgaccaatcacctgaccaaaacgcccgaagcccacgacaatgacctggggtttatcatcgttgacccacggtttttcgtcttcttcttccggtccgttaaactggcgggatagccatttatccaccagcttcatcagcaacggcgtggtcatcatggaaagcgtcaccgtcaccagcaacaacgccatctggtcgccctggaataagcgttgtgaagaagcggtagaaaagaggacaaaggcaaactcaccaccctgactcaacacgccagcaaactgcatccgctctgagctacgcacgccatacaatcgcgccagcagatacagcacgagaattttcaccgccaccagcacaaccacgcttatcactacccacaacagatgggtataaagcaccccgaggttgagtgacatgccgacagagataaagaacaaaccgagcagcaagcctttgaagggatcgatagccgtttccagttcatggcgatattcactttccgccagcagcacgcccgcaataaatgtaccgagcgccatcgacagccccagcgcatccataaacaatgcggaacccaacaccagcagcagcgtcgcggcggtgaacacttcccgcacgccagaagctgcaataaagcggaataccggacgcagtaaatagcgcccaccaatcagcatgccgacaaacgccagcaccttcatgccgaccttcatccagtcgaaatgttcgtctgccgaccccgccaacaacggcactaacgccagtgctgggattactgccagatcctgaaacagcagaaccgaaaacccgagctggccggattcgctgcgattcatccctttctcacgcatcaattgcaacgccattgcagttgaagacatcgcaaggccaatgccaccgaccaccgccgcctgccaggcgaaatccgtcagcatcaataatcccgccagcaacgccgcgcttaacagcacctgtgccgcgcctacgccaaaaatcgaacgccgcagttgccaaagtttggagggattcaactcaaggccgatgataaacatcaggaataccacgccgagttccgaaaagtggaggatctcatcgacgtcgctaataaaccccagcccccacgggccaattgcaatccctgccagcaaatatcccaacacagcgccaatacccagccgcgatgccagcggcaccgcagccaccgccgcgaagagaaacagcactcctgcgagtaaaaaatcggaaccttccatcagcggcctcctggagacagcggatttgccagccagtcaccgtaggctctggcgtggctcgccagctcctgtgcgctttgccgtctcgcccagtaaataatgatgggacttaaccaatgcatccggcacatgcccgccgccagttcaaaggggcgcagcacatcgctcatcgggtagcgattcagcgcgtcataacggtaagcactttccggctcgccggtggtaatcacgctacgccagtactttcccgccagttggtttcctcccggcccgctggcaaaaccacgacttaatacccggtccagccactctttcagtagcgccgggcagctataggtataaagaggatgctgaaagacaatcacctcgtgctcgcgcagtaatgcctgctcacgggggatatcaataaaaaaatcgggatagtgcgcgtaaaggtcgtgcacggtaacattgctgagctgcgtggccggtttaagcagtacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcaccttatgattgttttctcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacgccggcgttaccgcaagcggcgctggaatatgtcattgacggcgaccgtgaatatcgtcaactagaagcgcagctacacgacgccaacgaacgtaacgacgggcacgccattgcgaccattcatggcaagctggatgctattgacgcatggagtattcgctcccgtgctgccagcctgctgcacggcctcggtttcagcaatgaacaactggagcgcccggtaagtgatttttccgggggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgaccgcgacttcctcgatccgatcgtcgataaaattattcatatcgaacaacaaagcatgttcgagtacaccggcaactacagttcgtttgaagtacagcgcgccacccgtctggcgcagcaacaagcgatgtacgaaagccagcaggaacgcgtagcgcatctgcaaagttatatcgaccgtttccgtgccaaagccaccaaagcgaagcaggcccagagccgcattaagatgctcgagcgtatggagctaattgcccccgcgcacgtcgacaacccgttccgctttagcttccgcgcgccggaaagcctgccaaatccgttactgaagatggaaaaagtcagcgcgggctatggcgatcgcattattctcgactcgattaaactgaacctggtgcccggctcgcgtattggtctgttaggccgcaatggcgcgggtaaatcgacattaatcaaactgttagccggtgaacttgcgccagtcagcggtgaaattggtctggcgaaagggatcaaactcggctacttcgcccagcatcaacttgaatacctgcgcgccgacgaatcacctattcaacatctggcacgtttagcgccgcaggagctggaacaaaaactgcgtgactacctcggcggctttggtttccagggcgataaagtaaccgaagaaacgcgccgcttctccggtggggaaaaagcccgcctggtgctggcattaattgtctggcagcggccgaatctgctgctgctcgacgaaccgactaaccaccttgacctcgacatgcgtcaggcactcaccgaagcattaatcgagtttgaaggcgcgctggttgtcgtttcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaatgcgaacagcgcccaggcacgtaaagatcagaagcgtcgggaagctgagctgcgtgcgcaaacccagccactgcgtaaagagattgcccgtctggaaaaagagatggagaagctgaacgcgcaactggcgcaggcggaagagaaactcggcgacagcgaactgtatgaccagagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacgacgaccgatgccaatgaattcagcagcagtgctgaattcatccccatgcgcggctttagcaattgtcatctgcaaaccatgctgccgcgtctgtttcgtcgtcaggtgaaattcaccccgtactggcagcggctggagttgcccgacggcgattttgtcgatcttgcgtggagtgaaaaccctgcacaggcgcaacataaacctcgtctggtggtgtttcacgggctggaaggcagtctcaacagcccttacgcccacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgaatttggtcatgcgccaacggctgccgtcggctattcgctcggcggtaatatgctggcctgtttgctggcaaaggaaggcaatgatctcccggttgatgcggcggtgattgtctctgcgccgtttatgctggaagcctgtagctatcatatggaaaagggcttttcccgcgtttatcagcgttacttgctgaacctgttaaaagccaatgccgcgcgcaagctggcagcctaccccggaacgctgccgattaatctcgcgcagttaaaatcggtacgtcgcatccgtgaatttgacgatctcatcaccgccagaattcacggctacgccgacgctatcgactattatcgtcagtgtagcgccatgccgatgctgaaccggatcgccaaaccgacgctgattattcacgccaaagacgatccgtttatggatcatcaggtgatcccgaaaccggaaagtctccccccgcaggtggagtatcaactgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatattatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaggctaacgacttcggcctgctggaacaaaccttcattgaatacggtcagagcggcaaagggaaatctcgcaaatatctgcatacctacgacgaagccgtaccgtggaatcaggtaccggggacattcaccccctggcaacctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcagtagtgcgttcaatggaagactatatcaactacatcacaccgcagttttcccgcacccatcttaacttccagcgcgttcccaccgtcgacacttcaaacccgttcgcggcaaaaggtatcccgtcgctcgatgaaagctttgtggtgatccattttcgtaatctggaagggatcgatttcccctggctgctggcgatgttgcaaggctcattcatttcccacatcaatacgttagtggtaccgggcggcaaaatgggtctggcaatggaattaattatgctgccgctggtgcaacgattgatggaaggaaagaaaatcgagtaactctgctattacgccggataaaatactatccggcttcacaacgggatagttaagtcacgcggcaaccacttcatacgagtgagtaatattcaccgctttttccagcatcaacgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgttcagaggtcaattttacttcacaatcgaccacatcctgacgccctttttgcaggatcgaaaccacatcgatggcactgcaaccacccgccgccatcaacaccatttccatcggacttggtgctttatcgcctgagttgccgtccattaaaatctgatgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtttgtctgcacagatggcgcgtcgtctgcaagtcacttcagagaaagtgggcaacctggcgttcctcgacgtgacgggccgcattgcacagactctgctgaatctggcaaaacaaccagacgctatgactcacccggacggtatgcaaatcaaaattacccgtcaggaaattggtcagattgtcggctgttctcgtgaaaccgtgggacgcattctgaagatgctggaagatcagaacctgatctccgcacacggtaaaaccatcgtcgtttacggcactcgttaatcccgtcggagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggtctgctcttctccctcgttcctgcctgttgcaatattgcgggccttgatacgcctcataaacgttttttcaaacgcttaatcattggtgcgtcgctgtttgccacctgtagcttgctgacacagctactactggcaaaagatgttcccctgccctttttgctgaccggattaacgctggtacttggcgtcactgctgagctggggccattgcacgcaaaattgcttcctgcatcgctgctcgccgccatttttaccctcagtttggcgggatacatgccggtctgggaaccgttgctcatctatgcgttgggcactctctggtacggattgtttaactggttttggttctggatctggcgcgaacaaccgctgcgcgagtcactaagtctgctgtaccgtgaactggcagattattgtgaagccaaatacagcctgcttacccagcacaccgaccctgaaaaagcgctgccgccgctgctggtgcgccagcaaaaagcggtcgatctaattacccagtgctatcagcaaatgcatatgctttccgcgcaaaataatactgactacaagcggatgctgcgtattttccaggaggcgctggatttacaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccagcatccggataatccggttgggcaattctgctactggcatttcagccgcatcgcccgcgtgctgcgcacccaaaaaccgctctatgcccgtgacttactggccgataaacagcggcgaatgccattacttccggcgctgaaaagttatctgtcactaaagtctccggcgctacgcaatgccggacgactcagtgtgatgttaagcgttgccagcctgatgggcaccgcgctgcatctgccgaagtcgtactggatcctgatgacggtattgctggtgacacaaaatggctatggcgcaacccgtctgaggattgtgaatcgctccgtgggaaccgtggtcgggttaatcattgcgggcgtggcgctgcactttaaaattcccgaaggttacaccctgacgttgatgctgattaccaccctcgccagctacctgatattgcgcaaaaactacggctgggcgacggtcggttttactattaccgcagtgtataccctgcaactattgtggttgaacggcgagcaatacatccttccgcgtcttatcgataccattattggttgtttaattgctttcggcggtactgtctggctgtggccgcagtggcagagcgggttattgcgtaaaaacgcccatgatgctttagaagcctatcaggaagcgattcgcttgattcttagcgaggatccgcaacctacgccactggcctggcagcgaatgcgggtaaatcaggcacataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccacctgaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacagcgggttattggtcatctgaacaccatgcacaccatttcgtcgatggcatggcgtcagcgaccgcatcacgggatttggctgagtcgcaagttgcgggattcgaaggcgtaatgcaggctaaaccatcggataaggcattcacgccgcatccgacatcttttgcctgatgcttcgtatttacgccccaaccaccttcgccaccgcgtgggcgaaacgttgcatcccttcatcgatatccgcatcttccaccaccagcgacggtgcaaaacgcatcacatccggtccggcattcagcaccattacgccagcctctgcgcccgcatacaggaaatcacgcgcccgacctttgtactgtggtttcagctctgcgccaatcaacagccccataccgcgaatatcgctaaatacatcgtactgctgatcgatcttctgcagatggtcaacaaaacgctggcgtttcgcctgaatgccttccagcacttcaggggtattgatgatatcaaacgccgcccccgctactgcacaggccagaggattaccgccgtaggtggaaccgtgagaaccaggatgaaacgcagaagcaatttccgccgtggtcagcatggcgctaatcgggaagccgccgcctaacgctttcgcagaggtcagaatatccggcgtaacgccgtagtgcatgtaagcaaacaaatcgccggtccgccccatcccgcactgcacttcatcaaacaccaataatgcctgatgttgatcgcacagctcgcgcaagccctgcaaaaactctggcgtcgctgccgtcacaccgccctcgccctggatcggctcaaccaccaccgcacaggtgtgatcatccatcaccgctttcactgcatggagatcgttaaagggaacgtggatgatgtctgccggtttcggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacgcccaagacgcagcgccggttcattggtgaaaacgttactgatatgccacagagtttcgccctgggtttttaacgcgttcaccagcgcaggatggcaatggcccaacgccgtaactgcaatgccacccgcgaaatcgacatactccttgccttgctgatcccagattcggctgccctgaccttttaccggaataaactctgccggagcataaatcggcaggatcacttcatcgaaagtcgcgcgtgtaattgctgtttgttcaattgccatctcatgatcaccctgttacgcataaacaaatgtgaaattataaccacaaaatatgcataaaaaatcactaaatggcaatcagaaatcagcgatgcaggaaattagccagcagttgatgtccttgttcgctaagaatactttctggatggaactgcacaccttccagatcccactggcgatggcgaatccccataatctctcgggtttcgctccaggccgtcacgtcaaagcacgctggtaatgagtcaggttccaccaccagcgaatggtagcgtgtcacggtaagtggatttgccagcccccgaaatacgccctcaccgttatgtgtaatcggcgaggttttgccgtgcatgacctttgcggcgcgcacaactttaccgccaaatgcctgcgccattgcctgatgaccgaggcagacgccaagaatcggcaagcgcccggcatagtggcgaataacgtcaagggagatcccggcttcatctggcgtacaggggccaggtgagatgacaattttttgtggtttaagggcgtcgatatccgccagcgtcaacgcatcgttgcgcttaaccagcacatccgcccccagttcacaaaagtactggtagaggttccaggtaaaagaatcgtagttatctataagcaggatcatggcggctccggtacaaaagaaccgcgctattttactcagattccccggcttcgcttaccactttgctaaatatcatctgcagtgcggtgagatcccccattgccccactctgatttgcctgattccaggcctctttttcgataccctgccagctcagttgatatccggcatgaatcgccagttgctcgaagaagatccgctgtgccagaccacttcccacccggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcaccctgataaatatcaacttcacgcagttgccctgcccagtcgaaaatatcctgatacagctggcgatggatagttcgcaaatgcggtaaaccgcgcaccagcggaccaagctcaatggtcgcagcacgcagcgccgtcatttcgtaagcggcctgttccagccgctgctgctggcggatgttcagccggttacgcatgatatcaaggcctggataaagatacggatcgcgcccttcgccgaatttatcgctcatagtgactcctcagctcttcaaggcgcgctaaagcctctgcggcagtaagagtgactaaaggcatctcgacgccttcaagacggcgactggcctgaaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccatggtcaaggaaggcgttatcggcaacgttgataaagaactggctggtggcgctgtctttgtcagcggtacgtgccatcgcgatggtgccacgcgtgttgcgcaggccgttatcggcttcatttttgattggcgggtttggttttttctgctgcatctgctcggtgaaaccgccgccctgaatcataaagccaggaatgacgcggtgaaaggtagtgttgttataaaaaccgctgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgacgatcactttttattccgtgatcaaaatcacctcttaaaatgcaatttagcaaccgattgcaataaaacatttaaacagatcacaaaatcacctaaaatcgcccgctcgcggcatatcccgctatgccattttatttttgaacgcaggccaatcatgactaacagcaatcgcatcaagctcacatggattagctttctctcctacgcactgactggtgcgttggttattgtcaccgggatggtgatgggaaatatcgccgattatttcaatctgcctgtttccagtatgagtaataccttcaccttcctcaacgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaagggcgtcagcgcggttcccgcctgttatttaccgactccttcttcagtatggctgggatgattttcccaatgatcgccgcgtttctactggcgcgcagcattgagtggtactgggtttatgcctgcatcgggctggtgtatgtcgctatttttattctgaccttcggctgtgagttcccggcgctgggcaaacatgcgccaaaaacggatgctccggtagagaaagaaaagtgggggatcggcgtactgtttctctctgttgcggcgttgtgctacatcctcggtcagttaggttttatctcctgggtgcctgagtatgccaaaggcctgggcatgagcctgaacgacgcgggcacgctggtgagtaacttctggatgtcatacatggtcggcatgtgggcgttcagctttattcttcgcttctttgatttgcaacgcattctgaccgtactggctggtctggctgcgattctgatgtacgtctttaacaccggaacaccagcacatatggcgtggtcaattctcgctctgggcttcttctccagcgcgatctataccaccatcatcaccctgggttcacagcagaccaaagtaccgtcgccaaaactggttaactttgtcctgacctgcggaaccatcggtactatgttgacctttgtggttaccggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcaaccggttcctacccgtggatcccgccaatcaaaggttctgatactcaggactgctttgtctatcgcactattgaagacctcaacgccattgaatcctgcgcccgtcgcagcaaacgcggtgccgttgttggtggcggcctgttaggtctggaagccgcaggcgcgctgaaaaacttaggtattgaaacccacgttatcgaatttgcccctatgctgatggcagaacagcttgatcagatgggcggcgagcagctgcgtcgcaaaatcgaaagtatgggcgtgcgcgttcacaccagcaaaaacacccttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtattgtcattaatgattcctgccagacttccgatccggatatctacgccatcggtgaatgcgcaagctggaacaaccgtgtatttggtctggtagcacctggctacaaaatggcgcaggtcgccgttgaccatattctcggtagcgaaaacgcctttgaaggtgctgaccttagcgccaagctgaaactgctgggcgtagacgtaggcggtattggtgatgcgcacggtcgcacgcctggcgcacgtagctacgtttacctcgacgaaagtaaagagatctacaaacgcctgattgtcagcgaagacaacaaaaccctgctcggtgcggtactggtgggcgataccagcgactacggtaacctgctgcaactggtgctgaacgctatcgaactgccggaaaacccggattccctgatcctgccagcacactcgggtagcggcaagccgtctatcggtgttgataaactgccggacagcgcgcaaatctgctcctgcttcgacgtcaccaaaggtgatctgattgctgccatcaacaaaggctgccacacagttgcggcgctgaaagctgaaaccaaagcgggtactggctgcggtggctgtatcccgctggtcactcaggtactgaacgcggaactggcgaaacagggcatcgaagttaacaacaacctgtgcgaacactttgcttattcgcgtcaggaactgttccatttgatccgcgttgaaggcattaaaaccttcgaagaactgctggcgaaacacggcaaaggctacggttgtgaagtttgtaaaccaaccgtcggttcgctgctggcctcctgctggaacgaatacattctgaagccggaacatactccgctgcaggattctaacgacaacttcctcgctaacatccagaaagacggcacctactcggtgatcccgcgttctccgggcggtgaaatcaccccggaagggctgatggcggtaggtcgtatcgcgcgtgaatttaatctctacaccaagatcactggctcccagcgtctggcgatgtttggcgcacagaaagacgatctgccggagatctggcgtcagctgattgaagccggcttcgaaaccggtcatgcctatgcgaaagcactgcgtatggcgaaaacctgcgtgggtagcacctggtgccgctacggcgttggcgacagcgtcggcctcggcgtggaactggaaaaccgctacaaaggcatccgtacgccgcacaaaatgaagttcggtgtctccggctgtacccgtgaatgttcagaagctcagggtaaagacgtgggtattatcgccactgaaaaaggctggaacctgtatgtttgcggtaacggcggcatgaaaccgcgtcatgcggatctgctggcggcggatatcgatcgcgaaacgctgatcaaatatctcgaccgcttcatgatgttctacatccgtactgccgacaaactgacgcgtaccgcaccgtggttagaaaacctcgaaggcggcatcgattacctgaaagcagtgatcattgacgacaaactggggctgaacgcacatctggaagaagagatggcgcgcctgcgtgaagcggtactgtgtgagtggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccagtaactctggtggaggacaacgcatgagccagtggaaagacatctgcaaaatcgatgacatcctgcctgaaaccggcgtctgcgcgctgttaggtgacgagcaggtcgcgattttccgcccgtatcacagcgatcaggtgtttgcgatcagcaacatcgacccgttcttcgagtccagcgtgctgtcacgcggactgattgcggaacaccagggcgagctgtgggtcgccagcccgctgaaaaaacagcgttttcgcttaagcgacggcttgtgcatggaagacgaacagttttccgtcaaacattacgaagcgcgagtgaaagacggcgtggtgcagctgcgcggttaatgttttaacgggaggcgcaatgcctcccctttttgcatggtcctgtaataatcttcggtatattgcaggacattttttaaactttttgttttattttttgtttttattttttaaaggataatcaaatgtttacagacactattaataagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgatccatccgtacgccctttggtgatgggcgcgacctttggtatcgccttaacgctggtgattatcgccggttctgaactgttcaccggacacaccatgttcctcacctttggggtaaaagcgggcagcatcagccacgggcaaatgtgggcaatcctgccgcaaacctggctgggtaacctggtcggttccgtcttcgttgccatgctctatagctggggcggcggtagcctgctgccggtagataccagcatcgttcactccgtcgcgctggctaaaaccactgcaccggcaatggtactcttcttcaaaggtgcattgtgtaactggctggtttgcctggcaatctggatggcgctgcgcactgaaggggcggcgaaatttatcgctatctggtggtgtctgctggcatttatcgcgtccggctacgagcactctatcgctaacatgacgctgttcgcgctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacggatgatgacgcgcttaaccagcgcgtcagcgaagccgctgaagctcgtcgcatcttctgtaacgtggtcgatgcgccgaaagccgccagctttattatgccgtcgattattgaccgctcaccgctcatggtagcggtctcctctggcggcacctctccggttctggcacgcctgttgcgcgaaaaacttgaatcactgctgccgttacatctgggccaggtagcgaaatacgccgggcaattacgcgggcgagtgaaacaacagttcgccacgatgggtgagcgtcgccgtttctgggagaaattgttcgttaacgaccgcctggcgcagtcgctggcaaacaacgatcagaaagccattactgaaacgaccgaacagttaatcaacgaaccgctcgaccatcgcggtgaagtggtgctggttggtgcaggtccgggcgatgccgggctgctgacactgaaaggactgcaacaaattcagcaggcagatgtggtggtctacgaccgtctggtttctgacgatattatgaatctggtacgccgcgatgcggaccgtgttttcgtcggcaaacgcgcgggataccactgcgtaccccaggaagagattaaccagatcctgctgcgggaagcgcaaaaaggcaaacgcgtggtgcggctgaaaggtggcgatccgtttatttttggccgtggtggcgaagagctggaaacactgtgcaacgcgggtattccgttctcggtggttccgggtattaccgcagcttctggttgctctgcctattcgggtattccactcacgcatcgcgattatgcccagagcgtacgcttaattaccggacacttaaaaaccggtggcgagctggactgggaaaacctggcggcagaaaaacagacgctggtgttctatatggggttgaatcaggccgcgactattcagcaaaagctgattgaacacggaatgccaggcgaaatgccggtggcaattgtcgaaaacggtacggcagtcacgcagcgcgtgattgacggtacgctcacacagctgggagaactggcgcagcaaatgaacagtccatcgctaattattattggtcgggttgttggcctgcgcgataaactgaactggttctccaaccattaatttaacccgggccagagaattctggccttcttaatgactctttttatatattcagcaaataaaacatagccccttaataaatattatctgctaatgggttatattcaccgttacagcgacttacaaaattaagtcattcgctcactgacgccaattaaatattcctgtatcgttcttaacgagcagtctgcttatattcatataatcaatgaatattaattaatatataatacatagggaatgtaaatgaacaaatttattaaagttgcactggtaggtgcagtactggctacgttaactgcatgtactggtcatattgaaaaccgtgataagaactgctcttacgactacctgctgcacccggcaatttctatttctaaaatcattggcggttgcggtcctactgcacagtaagtctctgacagaaatcggctaacaccggtttaattgcccgacgccctctggattttccgagggcgtatttgtttctatgtccttcttgcccccgcccgtaaaaatattttcactttaaattcaatttgataactacatccattagccacagcgcgatcctgtgcgaaattttgtgatcttcctccacattacataacatcatatgttgttatattcatcatgcattgtcatgttaccttttaaatgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaatgttatctggagaaaataaaatgttggatattgataaaagcaccgtggactttctggtcaccgaaaatatggttcaggaagtggaaaaagttctcagccatgacgttccgctggtgcacgccatcgtggaagagatggtgaagcgcgacattgatcgtatttatttcgttgcctgcggatcgccactcaacgcggcgcaaacggcgaaacatctggcggatcgcttttccgatcttcaggtctacgccatttccggctgggagttctgcgataacaccccgtatcgcctcgacgatcgttgcgcagtaattggcgtttctgactacggtaaaaccgaagaggtaatcaaagcgctggagctgggccgggcctgcggcgcactcactgcggcgttcaccaaacgcgcggatagcccgattacctcggcggcggaatttagcattgattatcaggccgactgtatctgggaaattcacctgctgctctgctacagcgtggtgctggagatgatcacccgcctcgcgccgaacgcggaaatcggcaagatcaaaaacgatctcaagcagttgccgaatgcgctcggtcatctggtacgcacctgggaagaaaaaggccgccagcttggtgaactggccagccagtggccgatgatttataccgttgctgcgggtccgctgcgtccgctgggttacaaagaaggcattgtaacgctgatggaatttacctggacgcacggctgcgtgattgagagcggagagttccgccatggcccgctggagattgtcgaaccgggcgttccgttcctgttcctgctcggcaatgatgaaagtcgccacaccaccgaacgcgccattaactttgttaaacagcgtactgacaacgtgatcgtcatcgattacgccgaaatttcgcaagggctgcacccgtggctggcaccgttcctgatgttcgtgccaatggagtggctctgctactacctgtctatttacaaagatcacaacccggatgaacgccgctattacggtggtctggtggaatattaatccctctcccggcccggcaacgggccggatttacgcaaggagttacccgatgaaaacaggtatgtttacctgcggccaccagcggctgcctattgaacacgcatttcgtgatgcaagcgagctgggttacgacggcatcgaaatttggggcggtcgcccgcacgcgttcgcgccggacttaaaagcgggcggcatcaaacaaatcaaggcgctggcgcagacgtatcagatgccgattatcggctatacgccagaaaccaacggctatccgtataacatgatgctgggcgatgaacatatgcgtcgcgaaagcctcgacatgatcaagctggcgatggatatggcaaaagagatgaacgcgggttatacgctgatttccgcggcccacgcgggctatctcacgccacctaatgttatctggggacggctggcagagaacctaagcgaactgtgtgagtacgcggaaaacatcggcatggatctaatcctcgaaccgttaacgccgtatgaatcgaacgtcgtgtgtaatgctaatgatgtgcttcatgcgctggcgctggtgccttcgccgcgcctgttcagcatggtcgacatttgcgcgccgtatgtccaggcggaaccggtgatgagttatttcgacaaactgggcgataaattacgtcatctgcatattgtcgacagcgacggggccagcgacacgcattacattcctggagaaggcaaaatgccgctgcgggaactgatgcgcgatattattgagcggggctatgagggttactgtacggtggagctggtgacgatgtatatgaacgagcccagactctatgcccgccaggcgctggaacgctttcgcgcgctgctgccggaggatgagagatgaaaaccctggcgacaatcggcgataactgcgtcgatatctacccgcaactgaataaagcgttttctggcggtaatgcggtcaatgtggcggtgtactgcactcgctacggcatacagccgggatgcattacctgggtgggtgacgatgactacggcacaaagctgaagcaggatctcgcccgcatgggcgtcgatatcagccatgtccatacgaaacacggcgttaccgcacaaactcaggtggaactgcacgacaatgatcgcgtttttggcgactacaccgaaggcgtgatggccgactttgccctgagtgaagaggattacgcctggctggcgcagtatgacattgtgcacgcggcaatctggggacatgcggaagacgcattcccacagctgcacgctgcgggcaaacttaccgctttcgacttctccgacaagtgggacagcccgctctggcagacactggtgccgcatctcgattttgcctttgcctccgcaccgcaagaagacgaaacgctgcgtctgaagatgaaagcgattgttgcccgtggcgcaggaacagtgattgtcacgctgggtgaaaacggcagcattgcctgggatggcgcgcagttctggcgtcaggctcctgaaccggtgacggttatcgacaccatgggtgccggagattcgttcattgccggattcctttgcggctggtctgcggggatgacattaccgcaggcgatagcgcagggaacggcgtgcgcggcgaaaaccattcagtaccacggtgcctggtaggtataacgttggcgtgagcatcttcacgccaacgtgctgttacttgccggaaaacgaccctataatccgagtaattcattctttatttcagggtcgattatgtcagctacggaccgctactctcatcaactcctctacgctaccgtccgccagcgactgctggatgatatcgcgcagggggtttaccaggccgggcaacagatccctaccgaaaacgagctttgtacacaatataacgtcagccgcattaccattcgcaaagccatcagcgacttagtggcagacggcgtactgatccgctggcagggaaaaggcacctttgtacaaagccagaaagttgaaaacgccctgcttactgtcagtggttttaccgattttggcgtctcacaaggcaaggcgacgaaagagaaagtgatcgaacaggaacgggtcagcgccgcgccgttttgcgaaaagctgaacatccccggaaacagcgaagtgttccatctctgccgggtgatgtatctcgataaagagccgctgtttattgatagttcatggatcccgctgtcgcgttatcctgactttgatgagatttacgtcgaaggaagctccacctatcagttatttcaggagcgttttgacacgcgagtggtcagcgacaaaaagaccatcgatatctttgccgccacccgcccgcaggcaaaatggctgaaatgcgaactgggcgaaccgttgtttcgcatcagcaaaatcgcctttgatcagaatgacaaaccggtgcacgtctccgaactcttctgccgcgccaatcgcatcaccttaactattgataataaaagacattaaccgtaggccggataagatgcgccagcatcgcatccggcgatgctggcgcgttgaattttacatcccgtacgttcccctcaccctaaccctctccccaaaggggcgaggggaccgttcagtacggaatttagcttgacggtgctatccagcattaaatactggcaatactctcacgcaaaatccgcagcaccgtctcttcaccgctgcgattcgggttaatgcgaatcgcacaatgttctgattgtggattcgcctggcgaaacgttccggaaaggcgataaaagagcggcgggatttcatatttcgactctgcacccaccgggtaaggcaaggcaccgcgcttttgcgcctcttccagcactctggcggcaatcggctgatgaaactcgacaatcaacaccttcgactgcgcattagcaatcaccgcgcttttcacttccggcaccgcaccaccgttaagcaaagccagcaaccgttcagatacccctgcctgcaccgcgtgcatcactggcgcaaacaccagaccacgcaatacttccagcgcctgtgcgccctggatctggctaccgccggagtaaagcgtggcgcgaatacggttgataacatcagcatcgccgaccactgcaccaacaccctctggcccaaatagcttgaagcaggaaaatgtcgagacattcgcgccgcattcacagccgattcgagccaccttcatcaccgcatagttgtcatcggttaacgctggaacacctgccgcgcgcaacgttgccagcacatctgccagcacgtagctgtcctgcggctgctggcgcgtatgctgcaccagcgccgcatccggttgttgctcgtcgacgacctgcttcagtgccgacaggtcattgaaatcaacagtaataagcgtcagccccatctgctcaataataacccgtgtcgtcgggtaaacaggcgcgtcatgcaccagaagacgctgccccggtttgagcaaagccgccagcccggcgcgaatcgcgccagtccccgcgccctgcaccagcgccgcagcctgtgcgtgaaatgcatcagccagcacctgttccacacgctgggtaacgcgcggttgattcagtcctggcgttaagcctaaatcaccgccagtaagaaactcgctgccggggaaatggcgacaaatgctatccaccagcgcaaactgcttttgctgcgcctcaataatcgtcaggctttgcagaggaaacgtcttcataggtgccttccttaagccggaacgaacaggccaagccagtaaagaacattcagcagaataccggtgatcattactgccacgaccggtgccgccattttctgtaccggacggcccagggattcgttgaggaagtaaatggcaaccgcgatagagaatccggtataacccgccatcttaattgctgcgaaaatcgaaccgaccagcagcgccacttccatcagcatattcatggcgttacggatgttatccgacgcattacgcaccgacgggtagcgtcccagccatttgccgatcgaacgaagcagcaagacttccgccgaaataaccactgcgcctaataccgctgcaaccatcggattcggcgagagatagtccaccgcataaacaaaggtaaagcccgcaactgcatacacacccgttgctaacgcggtggtggcaatcaacggcacaaaccccagtccgcgcataaattctgccagagccgcctgattaatcagcgtttgcgattgttccggcgttacgcctgcggaatatgctttctccagtgtgaagatcgacacttcactgccagcaaaaatcttcatgctggcaacggcggcaatcaatgctcccacgatggcgatatagggtaagtttttgataatccgtgacgtgcgttcttcaaacaccgaaagcccgctggcatcaatgtcattttcatcacgatgacgcaggtcgtgagttatcgcgatccccagcagcatcaccatgccaataaagatttcgatggattcagggttaagatgtgggaaatagcgcacgactaccacacgggtcatcagtaccaccacggcggcgatcagactttgcttccagccaaactggtagaaaatcgccaccagcgggaacagtgcaaaagctgaaaccaccggcgagcttaattcccccaggctacctaatacatccaccggcagcgcggtcagcagctggtttactggcaacaggcaagtaaggatcaacacgccccagatagcgccaagaccaaacgccatcaggctgtttatcgccaggacgccgaggatatcggtaggaagaaagagtaaccatgcgttgagcagcccggttttcagggtaaaagagatccccaccgaggccacaaaaccaatgctcagaccaaaagcgatactccccgcctcgcgacggttcatatagccttcaatcagttgcggcaggatcgggcggatgccgtcatgaaaaacagccgccgagcgatgcgccagaagcgatgtcatacccgtcaggcacgccaccacgataatctgaatatacagatccatagtcgtgccttttatttcagatggttaatcagcatcggaatcgcgtgttcgacgtgctcaacggaaaggccaaacgccacttttccttcagcgatcattttggcgatatgctcgtctttcgctttaatgcctggtttggcaatggtgcaacttttgttatagcctatcaccgcgatggcaatcgacaatgccgcgcccgcaccggtattacacgcgccgatgtaataatccagttgcccggatttcaccttcattgccgcttccatgtcgttgtgaatgaaaacttcaaaacagccaggagccgtcgcttcaatagtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaggtggttagtaaatagtcatagccataaccaccgttggcttttaaatgggagcggcgcgtaatatccatcgacagcatgacgcggttcagcaacccacggtcgcgtagcgcatgaagcatcgcaatacgcttttcgtccgggtagtaactgttcttgccgatggtgtcgaactgcacgtacgcgccgagatcgatcatcttcaaaatgttgtcgaggttgtctttcagatcgcagtgaccaacggtgacgcgcgaaagatcaaccccgtgggcttgtagcaacgccagttgctccagccccatcgtgctgaacgacgtatgcgtggagatcgggcgtccggtctggttatgcgccagcgcagcggcaataaataccttctcttccagcggcgtaatctttccttcgctggtgccgatctccgcgatgatcccggctttcagctccgtgccatcgataccctgttcaatttcatcgaccatctcctgcgccagttcctgcacgctgcgggtcgccacatgttccgggaaaaacgcgtcctggtaataaccggtacaggccaccacgttgatccccgtctcgcgcattacatcaagcataaattgcgcattgcgccccatgtaacggttggtcatctcaatcacattacgcacgccccgggtcatcaggtcgttcatctcctggcaaatgaacgcatactgatcaaggcggcagtccacgttgtttttaaagccggagagatcaatatgcagatgctcatgggcgagggtgtaacccgtcggatcaaaactcatagggtgtctcctgcaaaccggagggaggaaagaaaagagcgaccattttgtggcggtggcgcgcggaaaaattcacacacggtagcccccacatcagaaagcgtggtgcgcacaccgagctgcgtagcgatcatcccttgctgataaaccagcactggcaccacttcgcgggtatggtggctgtgaccaatggtcggatcgttgccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctgaatgttggtgcaaataaacgccgtcggatgggtgttaaattcgttgagggtgatatccataatccgctggctatccaccagattttgccagctcacgccataaggattgttgacgatatctgccaccttacccaccagcacggttggcacgcctgcttcatacagtttttgtggcacctgcactttttcatcgacgccatagcccatatgcacgacctggaaaccgttgtcataagcgccagaacgcggcgcattgataccaataaagcgcccttctttgctttctgcggcatcgagaatgcgttgactgtcggttaacaggccaccaaatgtaatgacccgaccgacctgtacctgctcacgcacgatacgaccaattttgattgcgtcgtcaaaagagatcacagagagattggcggtaatgttatagacctggcctaaatccgcctcgagattatcgccaatcgcaaccgcctgattgacccacagaaattgcagatcatcgccacggcgctccacctgccagccagcggaaactaatgcctgctcaacacggtcaatcacatcgcgaaaaggcatccgcagcggcggtaacgggcgcgtgcctaaaatttcctgatgccccataaaggtatcgccaccttcatgttgcagctctgccacgccccaggttgcggaatctgacggctgcatatcgcctggcgcataacccaatgcgttgattagccccagcgtctccagcgttggtagctgcaaatgcggcaactggctcaggatgtgaccacatgtattcgctcccgcatcttgcggacgcaccagcgtgacatctttcattgcccctacgccaaagctatcaatcactaacaccacaaatcgcgccattacgcccccagagagtttccaagactgtcataacgaccgacgatttccggttcgccacgatgaataccggacaccagcaccacatcgctacgggtgacaaaaatctgcgtgcgaaaacagagcaccactgcactgcttaccggaaactcgcctgccagcggcagggtgtagtcgatactgctgtcatccacagttttgagattggtttcagtaatcttttgattttctggcgtaaacaccaacgcatgttgcgcatgaccacgacgatagtaaccgccgccgtagcagtagctgtcgccacggaaatgatgggagatttcacttaaccagagcatcgcgatacgttcaggctgatcgccctgctggtttgccggaatagtgcccgtcagcgcatgaccgggttcggcatgagtcacaccgtattgcgccagtaatggcagcgaagtgcagctggtcgctgaaggcgcgttcagttgctcaagtgcaataccagatttcgccagttgatcccgtgcctgtatcagcgtgtgaagattcggtgtcggcaaaacttttccgacagcctcatcccaaagcaggcaagggaaatgggtaagtccggctaaatgcagccctggcagattctggatttcggcgacaatctccggcaacaccttgagggcaaaaccgctctcctggcccggataaagaaaatcatcgtcgctataaactttaagcagcacagactggattcgcccggccttcaccgccgccgcagaaacttcccgcgctttgtcgagagtaaacacggtgatgacgtcggtgccctgttcaacggcgtcagcaacctgatgacaagggatttgtaccagatgcccctgatgcgccacaggcaaaccagcgcggcgcatgactcgcgcctctttgtaatccaccgccacaatgccgctgtagcctaatgccagcaatttttccgccagccacggattacgaccaaactgcttggtcatcagatacagttcaatgccgtaaagccgcgccgtctcaatcagccgcttaccgttttccagtatctgatccacgtcgatcacccagctgtccggggcgatcttgccctgctgccacaggcttagtgcggcggaaatcagcgccgggttctggcgtttcaatgcttctacaaacatcttgttgcctcgtttctgttccttgaattaaatattcatttttttgaatatttaggttgtgcgacgtggatttgtcgggagcttcaaacctcttcgttagcagccatccataatccataaaggttggccagcaaatagccttcttcacacgggttaacttccagtgcgaattccttcaacaacacctgatgcaattgcacaacggcttgccagtggctggattgcgccagttctgccagcaactcgttatccagcggctctatttcttcaccacggcgactgcgcatcagtgcactcgccatatgtgtcatcgccatcgttccttgctcactgcgcaccggcagatggcactctgtttccagtacgttgacgacctgcatcatgcctttgcagatgtccttatcaataacgcctgcctcgcaaagcaggttgagtctggtttccatatcagatgcctttcgtttaataactcggttcctgttccccactcactacccgttgttgatgggcgagcagggcgtgtttatctacaacggcacgcagcagttgttgcattgggtaatcatcgactcgcgtcaggaccacggcttcggtggcctgtaaaaatcgcggatcgtctgtgagcggcgtcgcctctaatcccagcatggtcagttcgttttccgccaccacgttccagatcaccgcatcgacatcgcctttaacaatgcgttgtaaactctcgtgataagagagatcgactcgttccacatcactaccgccaaaaaaaacatcggtcatgattttctgatccgccgaacggttatccagccccacgcgcttcacgtttgcggactcgcctttacggcaaatcaactggtgctcgccaacgtaggtgtgcggccccaactccagcgcgaggcataagcctttttgcgtgagataactttccgccgctagtcgcgaaaccaccgccatgtcatacacgccattaagcagacactccacgcgaatatccgcgccacgcatgtgcgcatagtaaaaaggaatgccatcaaactgggctttcaatccgctcgccaggccttcgtacaaacgggtatagggcaagggcattgcacataccacgttgttgatatccacatgagtcagcaatgctttgttatccatctcgaccagataactgccattgcgcccacggcgttcaatccgtatcgctccgcttgattccagcgttttcaacgcggcctgcgtcaggccaacggatgaacggcattcatttgccagctcatctatggttttcaatcgattaccgcacttttcacccaacaaataacgggccagcgtcgtgatgacgacgccttcttttttgataaacgttcgacgcataataaattttcagtaaattgaatatttatatcttcaggaatttgaagataaggcgcaacagcgagatgtggaaacggcgaggcacttcacattttttcggattattgcaaatgaggataaaaaaaccgggtttccccggtttcagagtgatgataaaagcaaaattgcctgatgcgctacgcttatcaggcctacatttccttgcaatatgtgcattactttgtaggccggataaggcgttcacgccgcatccggcatgaacaaagcgcaatttgccagcaatagtgaattacggcttcgccacaaaaccaatcgcttcgtacaccgcttttagcgtacgggaagcgtgcgcgctggctttttccgcgccatctttcatcacctgttgcaggaaggcttcatcgttgcggaaacggtgatagcgttcctgcaattcagtcagcataccggaaacggcatcagccacttcacctttcagatgaccatacatcttgccttcgaactgtttttccagttctgggatgctctggcccgttaccgctgaaaggatatccaacaggttggaaacgcccgctttgttctgcacatcgtagcgaactaccggcggctcgtcggagtcagtgaccgcacgtttgattttcttcactaccgatttcggatcttccagcaggccgataacgttattgcgattatcgtcagacttggacatcttcttggtcggctccagcagcgacattacgcgcgcgccagatttcggaataaacggctccggcaccttaaagatctcgccatacagcgcgttgaaacgctgggcaatatcgcggctcagttcgaggtgctgtttctggtcttcacccaccggtaccagattagtttgatacagcaggatgtccgctgccatcagcaccggatagtcaaacagaccagcgttgatgttctcggcataacgcgcagatttatctttaaactgcgtcatgcgactcagttcgccgaagtaggtatagcagttcagtgcccagcctaactgtgcatgttccggcacgtgggactgaacaaaaatggtgcttttctcaggatcgataccacaagccagatacaaggccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaactgatgggcaacctgccgcttttgccgcctgaatatcattgcgtgagtcgccgacaaacagcatctgttgtggggcaattcccatccgctcagccaccagtaacagcgggtccggatgcggttttttgttttgcacatcatcaccaccaatcaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcagaatacgtacctgttcttctgccggaatgtcgtcatcaacgggcggtttacccattgttttacgctgagtcgcacgttcctgacgcgcccaggtcaatgcgcgctccatcagaacatctgcgccgttaccaatccaggtaataacgcgttcttcacctgcgacgggcaactccagcgcatacagcgccatatctaccgcagcagcaagaccaggagcactgtcgaccagcgtaccatcaagatcaaaagcgacgccgcgaatatcttcaaacttattcatgacttacctttgccagttcactgcgcatttcatcaatgacttttttgtagtctggctggtcgaagattgccgaaccggcgacgaacatatccgcgcccgccgcagcgatttcgccaatgttgttcaccttcacgccaccgtccacttctagtcgaatgtcaaagccagactcgtcgatacggcgacgtacttcgcgcagtttatccagtgtttgaggaatgaaagactgaccgccgaaaccagggttgacggacatcagcaggatcacatccagcttatccatcacgtaatccagatagctcagaggtgtcgccgggttaaataccagacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcaggtgtacgtcgataggggcggtaatgccatagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcactggaatatggcgctcaaccagaccttcggcgatctccgccagatgcgcttgttgttcaagcgtaaaactgtttgtgtgatacgccgtaaagttggcggtcgcagacagcggtgcataaggcggatcgcaatagacgacggatgcatcatctgcgcgcgccatgctatcggcgtaagactcacaatagaaaaaggcattctgcgctttttcagcgaagtgatacaactctgcttccgggaaatagggttttttgtagcggccgaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaactcccgcaacgataaaccattgcgggagataaccttgattacttcagatcggcctgtacctgacgcagcggtttcgcccacgggtttttggcctggacatctgctggcaatgtagataccgcttttttcgcctcttctttcgaagcgtacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttcgccccagcagcgggtgttgctgtggtttgcgccggggatgccgtctgtactggagccgtagtcgccgtctcttttggtgctggcgtagaagtcgcagccggtgccttcgtgctcgccacaggggcagctggttcagtacgcttcggcgtctgtgctaccggcttcggctccgttttcacggttgcttgcggttttttcggttcaatcaccgcctgctgacgagctgggcgcgtagtggacggacgttcagcggtttgcgttttcgccgtgtcacgcgatgcattgccattgcgaacaggcgcaaccgttgcgggttcagtcggcaacgtggaattgaccgccacattgttcagctgttgctgattttgtggctgggtcagcgcattgttcaggtcaccctgcacttcaacacgttgttgaccatccgttgccaccggggtttgcccttgagtcggcgtagaagagatcggtggcagagaaacatcctgctgagtattttccgcagacgtggttcccggcgctggctgcacgccattcgcctgatcggtcgcattgccagcaagatcaatactcttctcgccagacgcggtttgatcgctggaagtggtcgagggggcttttagcgcagaaccgataccgatgatcaacagcagtagaaccagaatgccgacgcccatcatcatatactgacgagaagcgggtttactggctgcttttttgcgcttacgcggacgacgctctacgcgctcttcatccacggtttcatcttcggattcgtcaatttcttcttcgatttccggttcctcattgcgctctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcttgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgccttcagttcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcaggttggtagaacgcgccaatcatgtttttaccgaggggatggttgaccgcagttttgccgccaacggaggaatcgacctgcgacagtaacgtcgtcgggacttgaatgaaacggacaccgcgctgataactcgccgccgcgaagccggtcagatcgcccactacgccgccgccaagcgccaccagcgtagtatcgcgaccatgcggtttttgtaacaacgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatcggcctgctgtagcacctgccccggaacgttctggctgatgtgtaatttcagccggatgcgacctttttgtaacaccgtgggcgtgacctccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagcaagcgtccgttgatgcgcccaatgttaaaaccgacatgcgttgtcgccgtcgctacggagaggtcgctaccaagcgtggtgacttgcccaacgccaccagcgtgttgcgcatcggccagcgtccatttcacgcctaactcacgcaaacttttttcattaatggtgacaatatgcgccgacagctcaacctgcccgaccggcagatccatttgcgctacccactgttcaagcgcgcttaacgccgttttgttatctcgtagcaaaaggcgattggtgcgtttatcgacggtcatactccctttggcactcagtagcttctcccccgctttcgccagttctcccgcgtcggcgtattgcagggttatactgcgattttccagcggcagatttgcctgcgcccgcgcctgctccgcctcctggcgggcgatattgttattctgccaggcaatggaatgcactgagagaatgttgccttcctgccgcgttatcagtccggcgcttttcactacagtttgtagtgcctgcttccagggaacatctgttagatgtaacgacaccgtaccgctgacgtctggcgacacgaccaggttcaacttctcctgttcagccagcgcctgcaacacctgagctaccggaacgtcatccaccatcagcgtcactttttgcggctttgccgcctgtacgccgggtatcagcatcaacagtagtgcggctatccattgcttcatttgtatctccttgccgttgccacaaccattgtggcggttcgcagtttgtcccggtacccagcgttagtacgtctggcgtcagctgtaaaattgtccagccgttttccagcacatcgttttgctgcacccgtcgccatttcttttgcccgtcttttattacaccgatgatgcgctcgcctcgccctaccatcccctgatagcgccactggctaagttcgctaatccggcatagatcttccggcggtttaaaagggtcacgcataccggttaaaaggcacaatgcaatacctgccaacaaccagcgtttaaccctcatgcggcgtctccagttgtagcgtgaacaaaagatcatcaccttccacgcttaacgaaaaacggctcacgctgacgttgcgctctgccagccgtgtaaatgccgacggcactgcttcccacagcgttttcaacgccaactcgcctccctgcgcggatggatgccaggaaaccagttgcgcgccggataactgaaaatccagtggcgaaaagggcagcgttttttcctcgctgaagggagcggtgtctaccaggcgatacagtgcggcccactgctggtgatgacttgcccgtagtcgaattaatgcgtcgcgctcttcatggtgtgtcgatgacagaaaaatgagcgtaactaacatcagcaaccagaatgcccagcaaagctggcggaggcggggtgatgtggcgaaccaccagtcaaagaacatgttcatcgctaaccttccttgttaactgatactcaaattgccagcgtccctgcgcatcctgctgcgtggctccccgctgattgagatgaaaagatgcatcctggcggagtgacgtttctagtgcgtttaacgcggtaatgcttgttgtcagccccttgatctccagcgttccctgctgccagcttatcgttgtcagccaggcgtgctcgggtaaaagcgccgccagtgcttccagcgcagattgccagtcgcgggtaaattgtcgctggcgctgccgttgcgaacgctgttcgcgtaactgctgttgctccagcaaacgtggcttcgttatctgtaagctgcgggcgagttgttgttccgcctgaagcaaaactgcgtctatgcgcgcttcggcgctgcctgtcagacgcagtattagcgttatcccgacggccagcagcagaggcgcaacgaacatcagcaaccagaaacgcagaaaagcggtccggcgttgctgtcgccagggcaaaaaattaattggcgggttcatcagtacgccttcccaagcgccagccccagcgcgatggcaaagtctccacctggcggcggtagcggcggctgacgaacagaaacggcctcccagggatcaaatccgccttcgccacatatcgcgacgctttcgggatcaacggataacgctgccgccagctccttcgcgctagtcatccccaccgccagtttgcgcccccagctatagcgcgtcgcccacagccactgttcgttatcacgccaggccagacattgctgatgagaaggtaaaaaaggcaggaatcgctgtaatgcactggcatccggggtgatcgcgctcacatgaacacgcaacctttctgccagagtaagcagcgttgccagctctttgctttgcgcggcagtcacgttataggcgggactgagtgagtcttcgctgtaatcgaagcgcagggagtccggatccatatccagctcgcgggccatcgtccctgacagccaggccgtttgctcccgctcaccaagggacatcgacgggcgcggaaatgaccgctgtaatgtgcgactggcgggaaacgccaacataatgtgatgacgctgcggcagttcgcgactccacggtaacaacgttttagccagctgctgcgcatcaacaatccgcccatctttgataatgtcgttctccagcggcaaccgccaccagcgttgcaaaaagcattcttttgcgccccgcacgatcgcaaccgctaccgcttcttgctgttgtaaatgcaaaccaatttgccagatcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccaccggagatggtgaaagcctttatcgcgacagaagacagccgcttctacgagcatcacggcgttgacccggtggggatcttccgtgcagcaagcgtggcgctgttctccggtcacgcgtcacaaggggcaagtaccattacccagcagctggcgagaaacttcttcctcagtccagaacgcacgctgatgcgtaagattaaggaagtcttcctcgcgattcgcattgaacagctgctgacgaaagacgagatcctcgagctttatctgaacaagatttaccttggttaccgcgcctatggtgtcggtgctgcggcacaagtctatttcggaaaaacggtcgaccaactgacgctgaacgaaatggcggtgatagccgggctgccgaaagcgccttccaccttcaacccgctctactcgatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtgcagcaggccgcgcagcaggcggtacgtaataacgtgctggactacgacatgcgccacggctatcgcggcccggcaaatgtgctgtggaaagtgggcgagtcggcgtgggataacaacaagattaccgatacgctgaaggcgctgccaacctatggtccgctgctgcctgccgcagtcaccagcgccaatcctcagcaagcgacggcgatgctggcggacgggtcgaccgtcgcattgagtatggaaggcgttcgctgggcgcgtccttaccgttcggatactcagcaaggaccgacgccgcgtaaagtgaccgatgttctgcaaacgggtcagcaaatctgggttcgtcaggttggcgatgcatggtggctggcacaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttctcgctgggatgcaagtgccggttctgactggcagccgaagaactcaccaccgcagtatgctggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacactccgctggcattcctgattaagagtgctttgaacaccaatatctttggtgagccaggctggcagggtactggctggcgtgcaggtcgtgatttgcagcgtcgcgatatcggcgggaaaaccgggaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcagttagctaatggtggcaacagccgcgaagagtatttcatcgaaggtacgcagccgacacaacaggcagtgcacgaggtgggaacgaccattatcgataatggcgaggcacaggaattgttctgattaaaaaggcgcttcggcgccttttcagtttgctgacaaagtgcacttgtttatgccggatacggcgtgaacgcgttatccggctaacaaaatcgtgaaaactcaataaattgcagaaaccccataagcctgataaacattgtgcatcaggcaaacttcacgcatttacactcgcccctgccctttcaaccattcgcgcacgaggaacagcgcactgacattgcgcgcttcattgaagtcagggtcttccagcaaatccatcatatgcgccagcggccagcgcacctgtggtagcggctctggctcatcgccttccagtgattccgggtagagatcttgcgctaccacgatattcattttgctggaaaagtaagacggtgccatgctgagcttcttcaaaaaagtcagatcgttcgctccaaatccaacctcttcttttagctcgcggttagcggcttcgtagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctctcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggaacagtacatcaacgatgagaataccgttgaactgattcataccgattcgctgccgctggttatttcactcaacggtcatacgctgcaggagtacatgcaggaaactcgcagctatgccttgcaacctgttccgtcaacgcaggcgtcgattcgcggggaagagagtgagcaaatcgagctactcaatattcgcaaagaaacgcatgaagaatatgcgctgagtcgtccgcgcgggctgcgtgaagcgttgctgatcgtcgcctccttcctgatgttctttttctgcctgattaccccggatgtatttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatctcggtcaacaaaccgatatcgatatctatctcgaccgccatgtagtgcgtcagggacgatatctttcgctgcatgatgaagtaaaaaactttccgttacagcactggctgcgcagtacgattatcgctgcgggctcgctgctggtgctgtttatgctgttattctggatcccgctggatatgccgctgaaattcactctctcatggatgaaaggcgcgcagaccattgaagccaccagcgtaaaacaactggctgacgctggcgtgcgggtaggcgatacattgcgtattagcggtacgggaatgtgtaatattcgaacttccggaacctggagcgcgaaaaccaattcaccttttttaccgtttgactgctcgcagatcatctggaacgacgcccgctcattgccattaccagaatctgaactggtcaacaaagcgacggcattgactgaagcagttaatcgccagctgcaccctaaaccggaagatgaatctcgcgtcagtgcctcattacgttcagcaattcaaaaatccggcatggtattgcttgatgattttggcgacattgtactgaagacagcggatttatgttctgccaaagatgactgtgtgcgactgaaaaatgcgctggtcaatctcggcaacagtaaagactgggacgcgctggtaaaacgcgccaacgccgggaagctcgatggcgtgaatgtgttattacgcccggtgagtgcggaatcgctggataacctggtggcaacctccaccgcgccgtttatcacgcatgaaacggcgcgagcggcacaatcactaaacagtccggcccccggcggattcctgattgtcagcgacgaaggcagcgattttgttgatcagccctggccttcggcatcactttacgactacccgccgcaagaacagtggaacgctttccagaaactggcacaaatgctgatgcatacgccgtttaacgccgagggtatcgtcacaaaaatcttcactgacgccaatggtacgcagcatattggccttcatccgatcccggatcgttccggcctgtggcgctatctcagcaccacattgctgctactgacgatgctgggtagcgccatttacaatggcgtacaggcctggcgtcgttaccagcgtcatcgcactcgcatgatggagattcaggcctattatgaaagctgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaagcagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtctgaaagctgaaagaacgctgtttattgatgacagcgaagcgattctcgatgctgccgcgcaatttggtattcgttactgcctcggcgtgactaatcctgattccgggattgccgagaaacagtatcaacgccatccgtcactgaatgactaccgccgcctgatcccctcgctaatgtgaaggagacgccatgaaagagaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgtgcgcggcgaactggtaaccgtttcggaaaccctgcaacagatccttgagaaccacgattatccgcagcccgttaaaaacgtgctggcagaactgctggttgcgaccagcctgttaaccgctacgctgaagtttgatggtgatatcaccgtacagctgcagggcgacggtccgatgaatctggcggttattaacggtaacaataaccagcagatgcgcggtgtggcgcgcgtgcagggcgaaattccagaaaatgccgacctgaaaacgctggtcggcaatggttacgtggtgatcaccattaccccgagcgaaggcgaacgctatcagggcgtagttggtctggaaggtgataccctggcggcctgcctggaagattactttatgcgttctgaacagctgccgacgcgcctgtttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgctgaccttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagttgatagcatcctggcggaagatggcgaaattgacatgcattgtgattactgcggtaaccactatctgttcaatgcgatggatattgctgaaatccgcaacaacgcgtctccggcagatccgcaagttcattaatgagtatgtccggcagagagggctctgccggattttacgactaatacacctgatgcgctttgtcactcattcagattcacattcagcctttcaccatccactacaagatcgcgccacgctttaggcttcgtccccagttttccatccttcgcagctgtgagtaatttttctttcgttatttcgttcggaagtaaactcatatcaagcgcgtcccattcttttctgtctgagtcaaagccatagacaatgactctgtcatcattaaaagcaaacaggatccgctccgcctgaccatcactattcagatcttgctcgaccaggacgcaggcgtctttttcaatacaggtcatcacgttatagcgatcctggattaaggccgaccagaatgtcgcatcaggtttaacagaaccaggggcaattaacacattatcggctaatactttttccgatacctgttgctgaagatgttgctctccatctaacgccatcagcagatcccgcgcgcgtttcgggtctttcataaacccggcatcgcttttcagcgactcaagcgcagcacgtccatagcgaccgctctgctcgagcatgtagatagttacctggtctgacgtgtttttgccgctctgataacgcgccatatggctgttcacgctaatgcgcatactgtccagcaccggcgaattaagaagcaccagtatcaccaacaccaataacgaaaccgcaaggttcactttgccctgaagaacaacgggattttgccctttacgccagacgatgctgacaaaataccccagcgaccacaccagtaacaccagcaccgccagcacgccctgcaagcggtcgacagtccagccgtactgagcgacccgcagccataacgcccaggcggcgacgaacacatacagcggagcaaccagcaaagcggttttaatcaggcaacgcaacggccctgtccagggaagtgacgctttttgcggatcgcggacaatagccattaagatcaattgcaaaaaggccagcgtcaacagcaacccggcggcggagatgtggcgagaaatcgcgctcaggcccgtaaacggcagggtgatgataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaaccagtcggttgcaaaaaagagcgtattgaaaaacgtgatgccaacaagtttaaacaactcactccacagtaaaagcaccagccacgtcaagccattggcgagaaaaatcaccagtaatataagtacgttatgccatactgactggtaaaaatagcgatagcggctactgtcattgcggatgcgaaggctttgttgtatccacggtagcaacaacattgccatcaacagcagatagcaaccaaaatcccaaagcgccttttcagctctccaggggttcatgccatcagtttgccacttcagccagccgctcatccccagcgtggcaataaacactagcgccagccatccccaaaggcgcttctgtttaaaagagatcacggagaagagtaaaacggatgaaaacgcgacggtcgcaggcacgccataaacaatccaactgtgattttttccggaaagccaggcgatcagcaggtagcaaaccagaccctgaagtaatccggtagcaatcatcccccagcgtgttgcgggtgaaagttcaacgttatccatgttggttatccagaatcaaaaggtgggttaattatcgcatccgggcagtagtattttgcttttttcagaaaataatcaaaaaaagttagcgtggtgaatcgatactttaccggttgaatttgcatcaatttcattcaggaatgcgattccactcacaatattcccgccatataaaccaagatttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgacaacaaacctctctctccggaaacctggcagcatctgaaaggcctggtgaccaggcagctttccggcaaacgtctgttcgttgtcgacgctttctgtggtgcgaacccggatactcgtctttccgtccgtttcatcaccgaagtggcctggcaggcgcattttgtcaaaaacatgtttattcgcccgagcgatgaagaactggcaggtttcaaaccagactttatcgttatgaacggcgcgaagtgcactaacccgcagtggaaagaacagggtctcaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctccgccaacgttggtgagaaaggcgatgttgcggtgttcttcggcctttccggcaccggtaaaaccaccctttccaccgacccgaaacgtcgcctgattggcgatgacgaacacggctgggacgatgacggcgtgtttaacttcgaaggcggctgctacgcaaaaactatcaagctgtcgaaagaagcggaacctgaaatctacaacgctatccgtcgtgatgcgttgctggaaaacgtcaccgtgcgtgaagatggcactatcgactttgatgatggttcaaaaaccgagaacacccgcgtttcttatccgatctatcacatcgataacattgttaagccggtttccaaagcgggccacgcgactaaggttatcttcctgactgctgatgctttcggcgtgttgccgccggtttctcgcctgactgccgatcaaacccagtatcacttcctctctggcttcaccgccaaactggccggtactgagcgtggcatcaccgaaccgacgccaaccttctccgcttgcttcggcgcggcattcctgtcgctgcacccgactcagtacgcagaagtgctggtgaaacgtatgcaggcggcgggcgcgcaggcttatctggttaacactggctggaacggcactggcaaacgtatctcgattaaagatacccgcgccattatcgacgccatcctcaacggttcgctggataatgcagaaaccttcactctgccgatgtttaacctggcgatcccaaccgaactgccgggcgtagacacgaagattctcgatccgcgtaacacctacgcttctccggaacagtggcaggaaaaagccgaaaccctggcgaaactgtttatcgacaacttcgataaatacaccgacacccctgcgggtgccgcgctggtagcggctggtccgaaactgtaatgatttgaagctggagaatatctatccagtatcttatagaaagcaaaacgggaggcaccttcgcctcccgtttatttacccttcttttgtcgtgccctgcgcccgcgttaccggcactggcagccaggcgcgaatggaaagcccgccccgctcgctggtgccaagctccagcatcccgttatggttatccacgatacgctgcacaattgccagccctaatcccgtgccgctaatggtgcgcgcactgtcgccgcggacaaacggctggaacaggtgcttacgttgttccggcgcaattcccggaccgtcatcttccacctggaaccaggcgcgattcggctccgttccgctgctgactttgatccagccattgccataacgggcggcgttgaccaccatattcgccaccgcgcgtttgatcgacagcgggtgcattttcacttcaatgctgccggggtaaagcgcggtttcaatttcccgctcatagccactttcggcagcaatcacctcaccgagtactgcattaagatccgccatttccatcggcatctcctgcccggtgcgcaggtagtcgataaactgctcaatgatggcgttgcactcttcgatatctttattgatcgattctgccagatagccatcctgctcgctcatcatctcagtcgccaggcgaatacgcgtcagcggcgtgcgcaagtcgtgacttacccccgccatcagcagcgtgcggtcatccgccagttgcttaacaccagccgccatatggttaaaggcacgggtaacggaacgcacctccgaagcgccatactcacgcagcggcggcggaataatccctttaccaacctgcaaggctgcgtgttcgagatcgaccaacggtcggttctggatacgaataaacagccacgccccgcctatcgccaatagcataatcgccagcgtatagcggaacagcggagagaaatcgccctgatgaatttcggtcagcggcacgcgtacccagatattgggcgacagccaggttttcagccagacgacaggcgaacttttgttgacctcaacgcgcacttccgtcgggccgcccagttgctgcgccatctgatggcttaagaattcatagtgttgcgcccaacgcagacctgcctcttcggcagcctcgttggagtagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctggcgaacagcaaggtgacgatgagcaataacgtacgggcaaatgaacttcgtggcgagaagcgcaatcgcctcatgctttagagccgtccggtacaaagacgtagcccagaccccagacggtctgaatgtaacgcggatgcgctggatcttcttccaccatgcggcgcagacgcgaaatctgcacgtcgatggagcgttccattgcggaatattcacgaccacgggcaaggttcatcagcttatcgcgggagagcggctcacgcggatggctgaccagtgccttcagtaccgcaaactcaccgctggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacggatacgggccagcagttcacgcgggttaaacggttttggaatgtagtcgtcagcgccaatctccaggcctacgatacggtccacttcttcccctttcgccgtcaccataatgatcggcatcgggttgctctgactacgaagacgtcggcaaatcgacaagccatcttcaccaggtaacattaaatccagtaccataagatggaaagattcacgagtcagcaggcgatccatctgttctgcattagcgacgcttcgaacctggaagccttgttcggtgagataacgttccagcagcgcacgcaggcgcatgtcgtcatcgaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaaaaaggtgacctgggccgcaagtctgggcgaccgcagcgaaaatgctgactatcagtataataaaaagcgtctgcgtgaaatcgaccgtcgcgtgcgctatctcactaaatgcctggaaaatctcaaaatcgtcgattactcccctcagcaggaaggcaaagtcttttttggcgcgtgggtggagattgaaaacgacgatggcgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaaggccatcaacgccaccctaagcaaaaccgaactcgaagacctctacctgccctacaaacctaaacgccgcacccgcgggcaaatcgccattgaagcagggcttgagccgttggctgacctgctgtggagcgatccgtcacacacgccagaagtcgccgctgcacaatatgtttatgccgataaaggcgtggcagataccaaagccgcgctggatggcgcgcgctatatcctgatggaacggtttgccgaagatgccgcgctgctggcgaaagtgcgtgattatctgtggaagaacgcgcatttggtttctacggtggtgagcggtaaagaagaggaaggggcgaaattccgcgactatttcgatcatcacgaaccgttgtccacggtgccttctcaccgcgcgctggcgatgttccgtgggcgtaacgaaggcgtacttcagctttcgctgaatgccgatccacagttcgatgagccgcccaaagagagctattgcgagcaaatcatcatggatcaccttggcctgcgcctgaacaatgccccggcggatagctggcgcaaaggcgtggtgagctggacgtggcgcatcaaggtgctgatgcatctggaaaccgaactgatgggcaccgtgcgcgaacgtgcggaagatgaagcaatcaacgtctttgcccgtaacctgcacgatctgctgatggcggcccctgccggactgcgtgcaacgatgggcctcgatccgggtctgcgtactggggtaaaagtggcggtggtcgatgccactggcaaactggtggcgaccgacaccatttacccgcacaccggacaggccgcaaaagcagcgatgaccgttgctgcgctgtgtgaaaaacataacgttgaactggtagcgatcggtaacggtacagcttcccgcgaaactgagcgtttctatctcgatgtgcagaagcagttcccgaaagtgaccgcgcagaaagtaatcgtcagcgaagcaggcgcgtcggtttactcggcttccgagctggctgcacaggagttcccggatctcgacgtttcgctgcgtggcgcggtgtctatcgcccgccgtttgcaggatccgctggcggagctggtgaaaatcgatccgaaatctatcggcgtaggtcagtatcagcatgacgtcagccagacgcaactggcccgcaaactggacgcagtagtagaagactgcgtaaacgccgttggcgtcgatctcaacactgcttctgttccgctgttaacccgcgtggcgggcctgacgcgcatgatggcgcaaaacatcgttgcctggcgcgatgagaacggtcagttccagaaccgtcagcaactgttaaaagtgagccgtctggggccgaaagccttcgagcagtgcgcgggcttcttgcgcattaaccacggtgataacccgctggacgcgtctaccgttcacccggaagcctatccggtggtggaacgcattctggcagcaacacagcaggcactgaaagatctgatgggtaacagcagcgaactgcgtaacctgaaagcgtctgactttactgatgagaaattcggtgtgccgacggtaaccgacatcatcaaagagctggaaaaaccgggtcgcgatccgcgtccggaatttaaaaccgctcagtttgccgatggcgtcgagacaatgaacgacctgcaaccgggtatgatcctcgaaggcgcagtgaccaacgtcaccaactttggcgcgtttgtcgatattggcgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgactatgcgcctggatgagcagcctggcgaaaccaacgctcgtcgcggcggcggtaatgaacgcccgcaaaacaaccgcccggcagccaaaccacgcggtcgtgaagcgcagcctgccggtaatagcgcgatgatggatgcgctggcggcggcaatgggcaaaaaacgttaaacgcccgtactggcctacggttcgaatttgcacgaaatcgtagggcagataaggcgttcacgccgcatctggcaacgaacgccttgcctgacataaaagtgccggagaatatctccggcatttttattccacagccaaactcataatatattccggcaatatttatcatttcattaacaactgaaaccttaattaaacattagccagtccgggtaattcactattcgaattatattttcgctgcgatataaccttgagccacatcaacattgagtcagattattattcaaaccaacattcgcacacattttaagtattgctgatagaaaccattctcattatcattgtgttgttgattatttaatctctcctttgttggcaaatcatctggtctcatgtcgctgtcaaacgccccatgaggtagttatccagttaatgagaaacaagtaggcacctatgcaatacactccagatactgcgtggaaaatcactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgccgacctgctgattaacgtggtggatgcgtctaaccttgagcgtaacctgtacctgacgctacaactgctggaactcggcattccctgcattgtggcactgaacatgctcgacattgccgagaagcaaaatattcgtattgaaattgatgctctgtcggcgcgtctgggctgtccggtgatcccgctggtttcaacccgtggtcgcggtattgaagcgctcaagctggcgattgatcgctataaagctaacgagaatgtggaactggtgcattacgcacagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcctgctggctatcaacatcggcggggcgttacagccgctgtttgacgtcggctccgtggcgctatttgtgcatggtattcaatggattggctacacgctccacttcccggactggctgactatcttcctcgcccagggcctgggtggcggcattaacaccgtgctgccactggtgccgcagattggcatgatgtacctgttcctctccttccttgaggactccgggtatatggcgcgtgcggcgtttgtgatggaccgtctgatgcaggcgctgggcttgccggggaaatcctttgtgccgctgatcgtcggtttcggttgtaacgtaccgtcggtaatgggtgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtattgtgatggcggtgctgactggcctgatgctcaagtacaccatcatgcgcggtgaagcgacgccgtttgtcatggagttgccggtctatcatgtaccacacgttaaaagcctgattatccagacctggcagcgtctgaaaggcttcgttctgcgtgctggtaaagtgatcatcatcgtcagcattttcctgagcgctttcaacagcttctcgctgagcgggaaaatcgtcgataacatcaacgactcggcgctggcgtccgtcagccgggtgatcaccccggtcttcaagccaattggcgtgcatgaagataactggcaggcaacggttggcctgtttacaggtgccatggcgaaagaagtggtagtgggtacgctcaacaccctctacaccgcagaaaatattcaggacgaagagttcaatccggcagaatttaacctcggtgaagagctgttcagtgcgatagatgaaacctggcagagcctgaaagacaccttcagccttagcgtactgatgaaccccattgaagccagcaaaggcgacggcgaaatgggtaccggggcgatgggcgtgatggatcagaaattcggtagcgcagcagcagcttacagctacctgattttcgtcctgctgtatgtaccatgtatctcggtgatgggggctatcgcccgtgaatcaagccgtggctggatgggcttctccatcctgtgggggctgaatatcgcttactcactggcaacattgttctatcaggtcgccagctacagtcagcatccaacttacagcctggtgtgcattctggcggttatcctgtttaacatcgtggttatcggtctgctgcgccgcgcgcgtagccgggtggatatcgaactgctggcaacccgcaagtcggtaagcagttgctgcgcagccagcaccaccggtgattgccattaatggcttcacttattcaggtgcgcgatttgctggcgttacggggccgtatggaagcggcccagataagccagacattgaacactccacagccaatgattaacgccatgctgcaacaactggaaagtatgggcaaagccgtgcggattcaggaagaacctgacggctgcctctctggcagttgtaaaagctgcccggaaggaaaagcctgtctgcgcgagtggtgggcgctgcgttaaccttactccatcgcctgttttggaaagcccggtatgcgtctgcatccgggcttttttgcgtgcggctttccataaaaatgcaactcttgcagcacggcgtaagttcctttgaaagcatctcgcagggatgaaaactcgctaatacacaggtgtggagtggcgcgtagagtcgcggcattcaaacaacaggtgaaggaacgccatgagcaaaaagcagagttccaccccacacgatgcgctgttcaaactctttttacgccaaccggacacggctcgtgattttcttgcgtttcatttaccggcacccattcacgcgctttgtgatatgaaaaccctcaagctggagtcgagcagctttattgatgacgatctgcgtgaaagctattccgatgtgctgtggtcggtgaaaacggaacaaggaccaggatacatctattgtctgattgaacatcaaagcacctcaaacaaactgatcgcatttcgcatgatgcgttacgctattgccgcaatgcaaaatcaccttgatgctggatacaaaacgttgccgatggtggtgccattgttgttttaccacggtattgaaagcccctatccctattcgctgtgttggctggattgtttcgccgatcccaaactggcaaggcagctttatgcctccgcatttccgctgattgatgtcaccgtcatgcctgatgatgaaatcatgcagcaccgacgtatggcgctgctggagttaattcaaaaacatattcgtcaacgcgacctgatggggctggtagagcaaatggcctgcttattaagtagtggatacgctaatgacagacaaatcaaagggctgtttaattacatactgcaaactggcgacgctgtacgttttaacgattttatcgacggcgttgccgaacgttcaccgaaacacaaggagagtttaatgactattgcggaaagattgcggcaggagggggaacaatccaaagccctgcatatagccaaaataatgcttgaatccggagttcctcttgcagacatcatgcgctttaccgggctgtcagaagaagagttggctgcggcgagtcagtaaagttctgtctcgccatttcaaaagccacctacaccctctgcttcaacgccaccagcaggtgacaaaactcggccggatgcgaaataaatggcgcatgggccgctttggcgaagatatatgattcgctgtgaggccaaagtttatccagcatcggcaccactttgcgcggcaccagaccgtcgagatagccatacaatcgcaaaaacggcatggacacgttttgcagcggctgacggagatcgaccgttttcaggatttccagcccgccattaagcacgtcaacctccggcatcggtaacgccagaacggttttcttcaacgcccgcgcatcctggcgcgccgtttcagtccccatggtttgtaacgccaggaaccgctccactgtacgctgaaaatcatcactgagttgctgctgaaatcccgccagcacgtccggttttatccccggccactcgtcacgagcactaaaacaaggtgacgacgccacggtgaccagcgcctgaacacgctcgggatgggttaacgcaatctggcttgccaccagcccgcccagactccagcctaaccaaatggctttatcaggtgcctgttgcagcacggcttcggccatatcagcaagtgacagcgcaccaaatccccggctacgcccgaagccgggcaggtcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctcttttgacttacaaggatgaacatatgctaacagtaccgggattatgctggctatgccgaatgccactggcgttaggtcattgggggatttgttcggtctgttcacgcgccacccgcacagataaaacgttatgcccacaatgtggattacccgccacacactcccatcttccctgcggtcgctgcctgcaaaaaccgccgccctggcaaagactggtcacggttgccgactatgcgccgccgttaagtccgcttatccaccagcttaaattttcccggcgcagtgaaatcgccagcgccctgtcacgtctgttactattggaagtcttacacgctcgtcgcaccaccgggttgcaattgccggatcgcatcgtcagcgttccgttatggcagcggcgtcactggcgtcggggatttaatcagagcgatttgctgtgtcagccgttatcacgctggttgcactgccaatgggatagcgaagccgtcacacgtacacgggccactgcgacccagcattttctcagtgcccggctgcgcaagcgcaacctgaaaaatgcctttcgtcttgaattgcccgtgcaaggtcgccatatggtgattgtggatgatgtcgttaccaccggaagtaccgtcgcagagattgcgcagttgcttttacgcaatggtgcggcggctgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtggaagccaccgacacagccctgaaatttgacctgctgaccgcgtatgttgatgagttaagcgcaccatacctggaagatgcagagatcgattttgttaccgaccagttgggttcccagttaacgctgaaagccccgaacgccaaaatgcgtaaagtggcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttccatggtcgatgtgacgctgaaagaagggatcgagaagcagctgctgaacgaattcccggagctgaaaggtgtgcgcgatctcaccgaacaccagcgcggcgaacactcctactactaagttatcccctcttttgtagattgcccgatgcgacgctaaagcgtcatttcgggcctacgttgaacatgtgccagacgttggcgcagcattgctttgtcaaatcctcggttcgtttccccgcgataatatgaccaacctctcataatttaaatttaccccgctctggtgattctcaaacgccagatgttacccgtatcattcacatgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcggcgggacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcggctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggcaacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggttggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataacactgactgccggatgcggcgtgaccgccttatccggcctacgattcgggatgaattagtaggccggataagacgcgtcaagcatcgcatccggcatcaaccgcactctacttcttcttcgctgcagctctgcgccgtctgtccaaatccttcagcaacttgttcacgccatcatcggcaaacatcgactcaagcgttgcggaaagcttgcgtcgccagtttttatactggtaactggtgccaggaatattcaccggttcggccatatccagccagtcttccggctgtagtcctaacagagcactgttactgtcggcaatgtagcgctgcaaaccacggttcagcgtcggcgtcatcgacatcaacgatgccttatgcccggcacgtttcggcagacaaccatatttatgcagtgcatccagcagcccttgcttcgccagttcgcgatcctgatacagaccgcgcagtaccacttcatccggatacagccccagggttttgcccagcgttagatccccgcactcccagtaaccgcgcagcgttggcaggtcatgtgtcgccgcaaccgccatcgactgctccggatacgctttcggtgcacggaacgtcttctcgtggtcgttttcgaaatagagcactttgtaagagtacacaccgctgctgcgcagcttaccgacaatctctaccggtacggtaccgagatcttcaccaatcaccatacagcgatgacgtttactttcgagtgccagaatcgagagcagatcatccaccggatagtgaacatacgcgccctgatctgccgtctcgccatacggtatccaccacaaacgcagcatcgacatcacatggtcaattcgtaatgcgccgcagttttgcatattggcacgcaacagctcgataaacggttcataggcacgcgcggtgatgatatgcgggtccattggcggtaatccccagttctgccccaacgggccgaggatatccggcggcgcgccaaccgatgctttcaggcaatatagttcacggtcacaccaggtttccgccccaccttccgctacgccaaccgccagatcacgatacaagccaatcggcatttcatagccctggcttatctcccagcaggcggcaaactggctgtaagccagccactgcaaccagagataaaaatcgacgtcatcacgatgttcttcgcagaactgacgcacttctggtgaatccacgttctgatacatctctggccatgcaggccagccccagcgcatttcgtcctctttcacttgctgggcatgtagcgcatcaaaggctgcctgccagaacaggctgtcgccctgctctgcaacaaactggcgaaacgcggccatctgctcatcatcacgttgcgcgaaacctttccacgccattcgtaatgctgtcatttttagggcggtaaccgtggagtaatcgacccagtcggcatcgcgcgcctgttgcagcgtctgttgcgtggtcggcaactgccaccaggcctgagcctcttcgctaagatggaaatcttcaacggcgttaacgtcgatataaatcacattcagccaacggcgagaagacgggctgtatgggctggcgctctccggatttgccggatagagcgcatgaatcgggttcaggccaatgaacgacccgccacgttttgccacatccaccagcatcgctttgagatcgccaaaatccccaataccccagtttttttccgatcgcagcgtataaagctgaacgcaggcaccccacagcttttgtttattcagcaacgcctgcggttcgtaacagcgtttcggggcgacaatcacccggcaatgcgcgcgctggtcgtcctgggtgagtgtcagcgtgtgataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctctacataggctgcgaaatccgccatcaccagatacggatcgccgccctgtttgccgatactgtgcagcatctggtcgaaggcatgcttatcgccgtcgctgtatttaccgctttccagctctttcaatactgcgtccagcaccttatctttcttccgccatttcaccgggtcgtagcctttggccagaattgccttcacttgttccacggtatgaccaaaaataaagatattttcttcaccgactttctcggcgatttcaacgttcgccccatccagcgtaccgacagtaagcgcaccattgagcgccagtttcatattgccggtaccggaagcttctttacctgcagtcgaaatttgttcggagatatccgccgccgggatcagtttttccgccgccgaaacgcaataatccggcaggaacaccaccttcaacttatcgccaaccagcggatcgttgttgatcacgtcagccactttgttgatcgcaaagataatattcttcgccaggtagtagcccggtgccgctttcgcgccgaagaggaagacgcgcggtacgcgatcagcctgcgggttttcacgaatttctttgtacaacgccagaatatgcagcagattcaggtgctggcgtttgtactcatgcaaacgtttgatctgaatatcgaaaatcgcctgtggattgatctcaataccggtacgaactttcacaaactccgccagacggactttattcgcctgcttgatctcgcgatattgctgacggaatttcgcatcatcagcgaatttttccagattgatcagctgatcgagatcgttagcccactctttttgcagtgatttatccaacagagccgccagtgccgggttgcactgtttgatccagcgacgtggggtaataccgttggtgacgttatggaatttgttcggccatagctggtgatattccgggaacagatctttcaccaccagatccgagtgcagcgccgcaacaccgttcaccgcgaaaccgccaaccacacacaggttcgccatatgcacttgtttgtcgtgcaccaccgccagtttggcccacactttttcatcgcccggccaggttttctctaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtaatggcccaggcgtcatcccagctcatctggtgctcatcgatcagcacgcgcagcagttctggaatcgcgatagttgggtgggtatcgttcagctgaataacttcgtaatccgccagttcgtgcagtttacgccccgccagatgatggcgacgcaaaatatccgctaccgaacaggcacactggaagtattgctgcatcaggcgcagctttttaccggcagtatggttgtcgtttggatagagaactttggtcagtttttccgcattgatgccctgctgttcggcacgcaagaaatcaccgtcgttaaatttagtcagatcaaacggatgcgcgtgcgtcgcctgccacagacgcagcggctgcgccacgccattacgatagccgacaacggggagatcccacgcttgaccggtaatggtaaactccggctcccagcgtccgtctttcgtcactttaccgccaatccctacctgcacatccagtgcttcgttgtggcggaaccacgggtagttactgcgatgccagtcatccggcgcttcaacctgtttgccatcgacaaaagactggcggaacaaaccatattgatagttcagaccgtaacccgtcgcagactgaccgacagttgccattgagtcgaggaagcacgccgccagacgtcccagaccaccgttacccagcgccgggtcgatctcttcttccagcaggtccgtcagattgatgtcataagccttcaacgaatcctgtacatcctgataccagccgagattcaacaggttgttgcccgtcaggcgaccaatcaaaaactccattgagatgtagttaacatgtcgctgattcgccaccggcttggcgaatggctgagcacgcagcatttcggccagtgcttcactcactgctagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcaaccacttaaagctagtgcaaaccacaggattagcatcaaatcaatgcaatacagcgcagaaaatctgtatctaagtgcaaaaaatggccgttgcgtattttcaaaaagcggaaggtaactctataaattaagtaaaggagtgaaacagtttcataagtaaaatatccagtgtgctccatctcattcttaatagatttattaagatcatctttttagatggcactttcatcaggaatgaagaagaaacccttgcttaaatgaatctgatgaacataagggaaaccagtattcacgctggatcagcgtcgttttaggtgagttgttaataaagatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaactaagtcgtccggttcgactcgaccataccgtggttcgtgagcgcctgctggctaaactttccggcgcgaacaacttccggctggcgctgatcacgagtcctgcgggctacggaaagaccaccctcatttcccagtgggcggcaggcaaaaacgatatcggctggtactcgctggatgaaggtgataaccagcaagagcgtttcgccagctatctcattgccgccgtgcagcaggcaaccaacggtcactgtgcgatatgtgagacgatggcgcaaaaacggcaatatgccagcctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcaccctggtggtgttgtcacgcaaccttccgcaactgggcattgccaatctgcgtgttcgtgatcaactgctggaaattggcagtcagcaactggcatttacccatcaggaagcgaagcagttttttgattgccgtctgtcatcgccgattgaagccgcagaaagcagtcggatttgcgatgacgtttccggttgggcgacggcactacagctaatcgccctctccgcccggcagaatacccactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgccctcatcacccgtgtgaccggcgaagaaaacgggcaaatgcgcctcgaagagattgagcgtcaggggctgtttttacagcggatggatgataccggcgagtggttctgctatcacccgctgtttggtaacttcctgcgccagcgctgccagtgggaactggcggcggagctgccggaaatccaccgtgccgccgcagaaagctggatggcccagggatttcccagcgaagcaattcatcatgcgctggcggcaggcgatgcgctgatgctgcgcgatattctgcttaatcacgcctggagtctgttcaaccatagcgaactgtcgctgctggaagagtcgcttaaggccctgccgtgggacagcttgctggaaaatccgcagttggtgttattgcaggcgtggctgatgcaaagccaacatcgctacggcgaagttaacaccctgctagcccgtgctgaacatgaaatcaaggacatcagagaagacaccatgcacgcagaatttaacgctctgcgcgcccaggtggcgattaacgatggtaatccggatgaagcggaacggctggcaaaactggcactggaagagctgccgccgggctggttctatagccgcattgtggcaacctcggtgctgggtgaagtgctgcactgcaaaggcgaattgacccgctcactggcgctaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcattccagctgatcaacgagcagcatctggaacagctgccaatgcatgagtttctggtgcgcattcgtgcgcagctgttatgggcctgggcgcggctggatgaagccgaagcgtcggcgcgtagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccagagtttgcgaacaaccacttcctgcaaggtcaatggcgcaacattgcccgtgcacaaatcttgctgggcgagtttgaaccggcagaaattgttctcgaagaactcaatgaaaatgcccggagtctgcggttgatgagcgatctcaaccgtaacctgttgctgcttaatcaactgtactggcaggccggacgtaaaagtgacgcccagcgcgtgttgctggacgcattaaaactggcgaatcgcaccggatttatcagccattttgtcatcgaaggcgaagcgatggcgcaacaactgcgtcagctgattcagcttaatacgctgccggaactggaacagcatcgcgcgcagcgtattctgcgagaaatcaatcaacatcatcggcataaattcgcccatttcgatgagaatttcgttgaacgtctgctaaatcatcctgaagtacctgaactgatccgcaccagcccgctgacgcaacgtgaatggcaggtactggggctgatctactctggttacagcaatgagcaaattgccggagaactggaagtcgcggcaaccaccatcaaaacgcatatccgcaatctgtatcagaaactcggcgtggcccatcgccaggatgcggtacaacacgcccagcaattgctgaagatgatggggtacggcgtgtaagtttagccggataacgcgccagatccggcttacatctctgcatcattcaatgctcacccgcgttacgccatctgtttctatcaaactaaaccgcaccggcaagaaacgctccaccaccgcgatattggtcagcagatggcatgagggatgggcgaccgtaaattcccccgcgcccgccagcgccatcggtagcaccagttggtcagcaagatattcccccaccgccgccgtgcttgccaggtagcgtttcacctctttcaccaactgtgccgcaaccacctcggcactgacgcgcttttcaccgacgacaaaaaagcgttcggtgatattttcactttcgacttcaagcgagacggtattacccggcccctggtcgcgcggcaggttatgaatattctgttcatgcagggaaaaactccccgccagtgtagcgatttcacgctcagcaacatggcgcggcacaccagctaatagaacttctccacgcatctgcacaatgttcccgcgctcgccaagttgcaaggtgttaaacgatgccacgggcgagacttccgttgccaccacaccgcctccggcagggtaaaaaccgtggcgtaacagcgtggtttgctgatgaattcctattttcgccagcagcggctccagcacccggcggataaaatccgcaggcggcgccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccgggccggaagagcagacgctgcgaccccagctccgcgccttccacggttgctccgcaaatttccgtcgccgcctttaccgcggtcagatgctggcgcaacagccccggtttcgcccgcccggcacgaatgctggtgatggtaaatggctggccggttatcatcgacaggctcagcgccgagcgcaggatctgcccgccaccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacttcggcatctttacggcattccacatgcgcggtggcacgaatttgatcttccacgctgaacagttttttcgctttagttcggctcattacccgcccggcaccgtggctgcacgaacagaacgactcttcatttcccagcccacggacgataaagctttttgctcccatcgaaccgggaataattccatattgaccagcacgcgcagacaccgcgcctttacgcgtcacgtagatctcttcaccaaagtgctgttctttttgcacatagttgtggtgacagttgatctcttccatcgccagcgtttgtggctgtctgaccgttttctgcgtaatgctctgcaatgccgttaccacgttttccatcatcgcatcgcggttaaggctggcaaaaagctgcgcccaggccacggctttcaggtaatcatcaaagtattccgtaccttccataaagtacgccagatcacgcgacggcaacgtctcaagcgtttcctgcatctctttttgtgccagatcgataaagtaagtcccgatggcgttaccaattccgcgtgaaccggagtgcagcataatccacacctggtccgactcatcaaggcagatttcaataaagtggttaccggttcccagcgttcccaggtgtttatagttattggtattcaggaaacggggatatttttgcgttaaccactgataaccggcttcaagctcagcccatttagcatcgacgttaacaggtggattttcccaggcacctttatcacgtttacaacggccagtggtacgcccgtgcggcacggccgtttcaatcgcctgacgcagctctgccaggttttcaggcaggtcttccgccgttaacgcggtacgcagcgcgttcattccacagccaatatccacgcccaccgccgccggaataatcgcccctttggtcgggatcacgctaccaatggtggaacctttacccaggtgtacatcaggcattaccgcaatatgtttgaaaataaacggcatcttcgccgtattaataagttgctgacgcgcatcggcctctaccggcacgcctttggtccacatttttaccggggcattttcagtggtcagtaattcgtaattcattttgtttttctcttttcgttgtttgctgtcctgataattgcaaccgtcgtgccagaaaattaaataagcagcttaattttttaattcattgttttaaaaaagattatatctttacgtccgtaaccggagatttcccgcaaagccaatttaccgataatgaaatatcgtcttttataaggatatctaagatgcgtaaaacagtggcttttggctttgtcggtaccgtactggattatgccgggcgcggcagtcagcgctggtcaaaatggcgtccgacactctgtttatgccagcaagaatcgttggtcatcgatcgactggaattgttgcacgacgcccgctcgcgctcgctatttgaaacgcttaaacgcgatatcgccagcgtttcgccagaaacagaagtggtgagcgttgagattgaactgcataacccgtgggatttcgaagaggtctacgcctgcctgcatgatttcgcccgtggttacgagtttcagccagaaaaagaagactatttaattcacatcaccaccggtacccacgtcgcgcagatttgctggtttctgctggcagaagcgcgttacctgcccgcccggctgatacaatcttcacctccgcgcaaaaaagaacagccgcgcggcccaggtgaagtaacgattatcgatctcgatttaagccgttataacgccatcgccagccgctttgccgaggaacgccagcaaacgcttgattttcttaagtccggcattgccacgcgtaacccccacttcaaccgcatgattgagcagatcgaaaaagtggcgatcaaatcccgcgcgccgattctgcttaacggtccaaccggcgcgggcaagtcatttctggcgcgacgcatcttagagttaaaacaggcgcggcatcagtttagcggcgcgtttgtggaagtgaactgcgccaccctgcgcggcgataccgccatgtcgacgctgtttggtcatgtaaaaggcgcgtttaccggggcgcgggaatctcgtgaaggtttattacgcagcgccaacggcggaatgttgtttcttgatgagattggcgaactgggcgcagacgaacaggcaatgctgctgaaagccattgaagagaaaaccttttacccgtttggcagcgatcgccaggtgagcagtgattttcagcttatcgccggaacggtgcgcgatttgcgccagctggttgccgaaggcaaatttcgcgaagatctgtacgcgcggatcaatctctggaccttcaccctgccgggtctacgccagcgccaggaagatattgaaccgaacctggattatgaagtggagcgccacgcctcactcactggcgacagcgtgcgttttaacaccgaagcgcggcgcgcctggttggcttttgcgacctctccccaggcaacatggcgcggtaactttcgcgaactttctgccagcgtcacgcggatggccacctttgccactagcggacgcatcactctggacgtggttgaagatgagataaaccgtctgcgctataactggcaggagagccgcccctccgcgcttacggcgttgctgggcgcagaggcagaaaacatcgatctcttcgaccgtatgcaactggaacacgttatcgctatctgccgccaggcaaagtcgctttccgcagccggacgccagctttttgacgtttcgcgccagggcaaagccagcgtcaatgacgcggatcggctacgcaaatacctggcgcgttttggtctgacgtgggaagccgtgcaggatcagcacagctccagttgaatatggtggtccgtcagcacctgcatcacgcttactggcggcggggcgtcggtgtagacggcatctaccatgctgatgctgcccatattgaccatcgcgttacggccaaatttcgagtgatcgacaaccagcataacgtggcgcgagttctcaataatggcgcgtttggtgcgaacttcgtggtaatcgaactccagcagcgagccgtcgctatcgatgccgcttatccccagaatgccgaaatcaaggcggaactgggagataaaatcgagcgtcgcttcgccaatgatcccgccatcgcggctgcgtaattcgccaccggcgagaatgatgcgaaaatcttcttttaccatcaacgtgttagcaacgttgagattgttggtgacaatgcgcaaattgctgtgattgagcagtgcgtgcgctaccgcttccggcgtggtgccgatatcgataaacagcgtcgagccattggggatttgctccgccactttgcgggcgatgcgctctttttcttcggtctgggtggccttgcgatcgtgccacggcgtgttaaccgaactggaaggcagcgccgcaccgccatgatggcgcaggatcaggttttgctccgccagctcattgaggtcgcggcgaatagtctgcgggctgacggagaaatgctctaccagctcttcggtactgacataaccctgctgtttaaccagttcgataataccgttgtgacgttgtgtttgtttcatttataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctgataagcgtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagtgttggatcgaatggccaggccagccataacatcacttcctgatcgccgagaatttgcatggcaataaacaccaccacgcaggcgatcatcatcacccaggttaccggacctgcgcgttcacgcaaggcggcaaagaaaggataacggcgataatgcaggccactgccggtatggcctgcctgccagctcgccgccagataacgcggatctgccgggttttcgagaaaacgcgccagctccgcccgtacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactgacgttgccaggcttcaaagccgccgtcaatgctatagaccacatcgtagccctgttgcagcagatactgcgccgcgcctttgctgctattgccgtgataacacatcaccatcaccggagtgtcaaagtcgttatcacgcataaaagcgcccagcgtgtcgttggttaaatggaaagcctgcaccgcatgtcccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacctaaagcgcgattctttgctaatatgttcgataacgaacatttatgagctttaacgaaagtgaatgagggcagcatggaaaccaaagatctgattgtgatagggggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctgctgaaaatggccccgcatatcgccttcccgatgcgttttcgcctgccacatcgtccgcatctgcgcccggcgtggatgattcgcattggtctgtttatgtacgatcatctgggtaaacgcaccagcttgccgggatcaactggtttgcgttttggcgcaaattcagtgttaaaaccggaaattaagcgcggattcgaatattctgactgttgggtagacgacgcccgtctggtactcgccaacgcccagatggtggtgcgtaaaggcggcgaagtgcttactcggactcgcgccacctctgctcgccgcgaaaacggcctgtggattgtggaagcggaagatatcgataccggcaaaaaatatagctggcaagcgcgcggcttggttaacgccaccggcccgtgggtgaaacagttcttcgacgacgggatgcatctgccttcgccttatggcattcgcctgatcaaaggcagccatattgtggtgccgcgcgtgcatacccagaagcaagcctacattctgcaaaacgaagataaacgtattgtgttcgtgatcccgtggatggacgagttttccatcatcggcactaccgatgtcgagtacaaaggcgatccgaaagcggtgaagattgaagagagtgaaatcaattacctgctgaatgtgtataacacgcactttaaaaagcagttaagccgtgacgatatcgtctggacctactccggtgtgcgtccgctgtgtgatgatgagtccgactcgccgcaggctattacccgtgattacacccttgatattcatgatgaaaatggcaaagcaccgctgctgtcggtattcggcggtaagctgaccacctaccgaaaactggcggaacatgcgctggaaaaactaacgccgtattatcagggtattggcccggcatggacgaaagagagtgtgctaccgggtggcgccattgaaggcgaccgcgacgattatgccgctcgcctgcgccgccgctatccgttcctgactgaatcgctggcgcgtcattacgctcgcacttacggcagcaacagcgagctgctgctcggcaatgcgggaacggtaagcgatctcggggaagatttcggtcatgagttctacgaagcggagctgaaatacctggtggatcacgaatgggtccgccgcgccgacgacgccctgtggcgtcgcacaaaacaaggcatgtggctaaatgcggatcaacaatctcgtgtgagtcagtggctggtggagtatacgcagcagaggttatcgctggcgtcgtaaattaacgtaaggtgatcaggtcagatttcaatctggcctgagactgatgacaaacacaaaactgcctgatgcgctacgcttatcaggcctacgtggtttatgcaatatattgaatttgcatggtcttgtaggccagataagacgttcacgtcgcatccggcatgaacaaagcgcactttgtcaaaaatctaacctactttttaattcagggaattaccgcaaagcccacgccatcatacccaacgtaacaaaactcaggcacgttccccactcgccccgagaaaaatagcattaatgcgcccagcgccagcataaaaattttgagcagaaggtaaattgttggcgtgataaggatattacaaacttcaataataccggcaagtccgacacccagcatggcaataaccaccgccaaaaattgcgccagtatggggatgccgaaaaaagtcattaccagcgaggtcaaaatccattttctgttttgcattattctttccattctttttgaatggtgaaattatactccccgagtccccttgccccttctggacacttttccgaaatgatggcggaaaaaaacgggaccctttggccccgttctatttattggtgaacttacaatctcaccggatcgatatgccagatatgatcggcgtactctttgatagtacggtcagaagagaagtagcccatattggcaatgttcagcatcgcttttgcggtccactcttcctgaagctcgtagagttcatcgactttatcctgacaatcgacatagctgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaaaataaagatattgtcagcaccgacatgatccagcatctcgacattcgcaccgtccaacgtaccgatagtcagcgcaccgttaagcgcaaacttcatgttactggtgccggaagcttccgtccctgccagcgaaatctgttcagacagatctgccgccggaatgatcaactgcgccaggctaacgctgtagttcgggatgaacacgactttcagcttatcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtaatcacatgcaacacattcatcaattgacgtttgtattcgtgaatacgtttgatttgtacatcgaacaacgcctttggattcaccaccacattcagctgctgggcgatatactctgccagacgctttttgttctccagcttcgcctgatgcacagcgtgattaaccattgggaaatcacagtgttgttgcagctcattaagcaggctaaggtcggtgcgccagttacggcccaggtgttcgtccagcacggctgaaagcgatgggttcgctaccgccagccagcgacgcggcgtcacaccgttggtgacgttggtgaaacgacccgggaagattttcgcaaagtcggcaaacaacgattgcaccatcagattagagtgcagttccgatacaccgttaactttgtggctcacaacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcaaccggccaggtttccagcgcctcgctcatcagcgtgtggttagtgtaggagaagacctgacaacacacctcaaacgcgtcgtcccagctaaattggtgctcatcgatcagcagacgcatcatctcaggaatcgacagtaccggatgggtatcattgagatgaatcgcgattttatccgccaggttatcgtaggttttatgcaactgataatggcggcttaaaatgtcctgaatggtcgaggaaaccaggaagtattcctgacgcaggcgcagctcacgcccggagtaggtggagtcatccggatacagtacgcgagatacgttctcggagtggtttttatcttccactgccgcgaagtagtcaccctggttgaatttaccgaggttaatttcgctactggcttgcgcactccacaaacgcagcgtgttggtcgcgtcggtgtcgtaaccagggattatctgatcgtaagcgactcccagaatctcttcggtttcaatccagcgcgtttttttaccttcctgctgaatgcgaccgccaaaacggactttatagcgcgtgttgtggcgtttgaattcccacgggttaccgtattccagccagtagtctggcgactctttctggctaccgttaacgatgttctgcttgaacataccgtagtcatagcggatgccgtaaccgcgccccggcaaccctaacgtcgccagagaatcaaggaagcaagccgccagacgtcccaggccaccgttaccgaggcctgggtcattttcttcatcaatcagctcttcgagatttaaccccatcgcttccagtgcgccctgtacatcttcgtaaattcctagcgacaacatggcgttggagagcgtacggccaatcaaaaactccatcgacaggtagtaaacctgacgagtttcttgcgacaactgggcacggtttgaacgtaaccagcgctccacgagacgatcgcgcacagcaaataacgttgcgttcagccattcatgtttattggcgacgaccgggtcctttccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctgaccggggtattccgctgccgccgcaaggaaaccttcctgcagcaccggatcgcccgcgccgagtagcgccagctgcccgccctgctccagaagacccggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttggactgaccgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtaaatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggaaaccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtagatacccatactcgccagagatttgctcggatcgttcggcattgacggcgggttagcaggtttttcaacgaattcgataattttatcgttctcatcaaccgccataacgccaaatgcggaggcttcttcaatcggtactggcatacaagcaacggtgcaacgtgcgcctttttcgacgtgatcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctgaatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccaccaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgccgccgttcaaccaggtcaagagaaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgaccattacgtttaaaaacatcgctggaggcagcaaaacgcccggcaaacgcccccagaggcaaatcataatgtagccagaaacgacgggcagcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacggaactctggcgtacggcccatgactgccgccagatcaaagcggaaaccatcgacgtggcaggtttctacccaataacgcaggcaggcgctggcataatccaccaccgccggatgactcaaattgagcgtgttgccgcaaccggtccagttgtgataatcgccgtcttctcttatccaataatagctacggttatcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtaaccccagtagttacttagccccatgcgttgcagacgtggttcactggcaaactgcgccactggcagcagttccagcgcggtaatgcccaattgtttcaaatagttgatcatcaccggatgcccgagggctttataagtgccacggatctcgaccgggatctccgggtgcaagtacgttaatcctttgacatgggcttcataaatgatggtgctgccccacggcgtgcgcggcggggcatcatcttcccagtcatagtgatcaaccaccactacgcatttcggcgcaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaggggccatgaacgcgataaccataacgcaaacccgggcgcgcatccggcagataaccgtgccaaatgtcgccactgtgccctggcaagtcatagcgatgttcctggccattggcgtcaaagacacacagttctacccgctcggcatgagcggagaaaagtgtgaagttgacgccctgaccgtcgtaatgcgcgccgaggggagcgggtttgccaatggcgagttgtgtcattctgcctcccgaaccagccagatagtggccagcggtggtagcgtcaggcttagtgaatgctgacgaccgtggctggcaatctcatcgctgtgtaccgtgccgccattgcctgcattactgccgtgatagtgcatggaatcggtattgaggatttcacgccatttgcccggctggtttatgccgaagcgataatcatgacgcggtaccggcgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgaggttcagatcgcgcaccagacgctggacaccgtggtgccagttatcgccgccttccaacagatgccagtcgaggctggcgtcatggttccactcgcggccctgggcaaattcgttacccatgaacagtagtttcttgcccgggaatgcccacatccagccatagtaggcgcgcaggttcgcgaatttctgccatgcgtcgcccggcatgcggtcgagaatcgattttttaccgtggaccacttcatcatgcgacaacggcaggacgaagttttcagtgtagttgtagagaatcccgaaggtcagtttatcgtgatgatactgacgataaaccgggtcgagcttcatgtagtccagggtgtcatgcatccagccgaggttccacttgtaccagaagcccagaccgcccatatcctgcggacgagaaacgccagggaaatcggtagactcctcagccattgtcaccgcaccggaaacctgctcaccaagaatacggttggtattacgcaagaattcaatcgcttcaagattctcgcgcccgccaaattcgttcgggatccactccccctctttacggctgtagtcgcgataaatcattgacgccaccgcatcgacgcgcagcgcatcaataccaaaacgttcaatccagtaaagcgcgttaccgacgaggaagttactgacttcacggcgaccatagttgtagatcagcgtgttccagtcctgatgatagccttcacgcggatcgctgtgttcatacaagttcgtgccatcaaattcggcaagcgcaaagtcatcagtcgggaagtggcctggcacccagtcgagaatcacgttcagaccagctgcgtgtgcggcatcaatgaaataacggaagtcgtcgcgagtaccaaaacggcgggttggcgcatacaggccggttggctgataaccccaactgccatcgaagggatgctcgttaatgggcagtagttcgaggtgggtaaagcccatccatttagcataaggcaccagttgatcggccagctcgcggtagctcaaccagaaattgttgtcggtgtggcgacgccaggaacccaggtgaacttcataaatagagattggcgcatcaaactgattcgcttttttgcgctcttcagtctgtacaaccttttccggcagcccgcaaataagagacgcggtttccgggcgcatttgcgcttcaaaggcataagggtcggacttcagacgcaagttgccattggcatcaatcatctcgtatttatagagctgaccgttatgcgccccagggataaacagttcccagatgccgctctctttacgcaggcgcatcgggtgacggcgaccgtcccagtagttgaattgcccaaccaccgagacccgacgggcgtttggagcccagacagagaaacgcgtacctgtgacgccatccatagtatctgcatgcgcgcctaaggtttcatacgggcgcaggtgagtaccttcagataatagccaggcatccatttcctggattagcggaccaaaacggtaaggatcatcaatcaggttttgctgaccatgccagacaacagccaactgatagcggaaaaaattcttacgtcgcggaatgacgccgctaaagaatccccgtgagtcgagacactccagttttgcgagtttgcgcccggttttcggttcaatcacccacacatcggtagcgtcgggtaaaagggcacggacttccagtcccgcggtggttttatgcattcccagtacggaaaaaggatccgcaaaatggcctgcaattagcgcgttaatcacgtctctatcgatacgatcggacatgcttgtcttcctgttttattgtgtcaccccatccaattggatttttgacttctggttgtgacatttttttgacctgaacggcgcagcactctgtgcatcctctctgcgtcgtcctcacttcaggtaaggctgtgaatactcatgtattcagccacccttaaagaatagccaatgctctatttaactcccggtaaatcatgaaacatctgcgcttactcctgtattacgcactaacaggggcggcatcgcgccccagatttaatgaataaagattacgccagttgacgaagcatccgacgcagcggctccgcggccccccacagcagctggtcgcccacggtaaaggctgacaggaactctggtcccatattcagcttacgcaggcggcctaccggcgtggtcagcgtgccggtaacggcagctggggttagctcacgcatagtgatttcccgatcgttcggaacgactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcgagctgtttgtcgatccacggaatcaggctacccgccagcggcacgccaaagttatccaccggcagctcaccgctacgggttaaggttgtgactttgcgttcgatatcgagaatagcagaggacggggtcgcgagttcatctgccacatggccatacagatggcccatctgggttaataactcacgcatatgtcgcgcaccaccgccggaagcggcctggtaggttgcaacggacacccaatcaacaagatcattggcgaataaaccacccaacgacatcaacatcaggcttacggtacagttaccgccaacaaaagtcctgatgccattatttaatccgtcggtaatgacgtcctgattgacggggtcaagaatgatgatggcgtcatctttcatgcgcagagacgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctggccaagctgagaagtagaaaagaagacagggcgaatggcgtcgaagtcgcgctcttcaaccatgcgttgcatgagaacggagccgaccataccgcgccagccgataaaaccaacatttttcataagcgtttttttcctgcaaagatgtgtgctgtataaatgtgccggtctcctcttggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctcctggtgatgctggtgttcctgtttgcgggtgagaaaattctggcatttcttagcctacgagcagaaaccgtctccatttctggcggcatcattctgtttctgatcgccattaaaatgattttccccagcgcttcaggaaatagcagcgggcttccggcaggtgaagagccatttatcgtgccgttggcaattccgttagtcgccgggccgactattctcgccacgctgatgttgttgtctcatcagtacccgaatcagatggggcatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaacccagatgttcctcgacggcattcgaatgtggatgaaggggtaacgaggagagtttttcgaaaagaacccggtagcgtcacaactaccgggcgaacaaacttaactcaacagctggaacgcaatcatcccaacgatggcaccgacagtgccgaggatggtttccatcatggtccaggttttcagcgtttcggcttcggtcgcgccggtaaatttaccgaacaaccagaaaccggcgtcgttaacgtggctgacaacaatcgaaccaccagcgatacaaatcgacagcgccgccatttgcgcaccggagtagttcagttgttcaataaccggcatcaccagtcctaccgccgttaaacaggctacggtggcagaaccctgaatgatgcgcactgcagctgccagcacgaagcaggtgatagcaatcggcaggcccatgccggttaacgcttcgcccagtgccggacctacgccagagtcaaccagcacctgtttgaacacgccgcccgcaccaatcaccagcagaatgatccccgccggttgcagcgcgtgaccgcaaatctccatcactttgtcttttggcatgccctgacgcattgccagaccgtaaatcgccaccagacaagcaaccagaatcgcggtaaacggatgaccgataaactcaaaccattcgtaagcagttgatccttccggcacaaaacgcgcggcaatggttttcagccctaccagcaccagcggcagcaggatcagcgacaggctgaatccgaaagatggcattttgccttcgccgagatgcggttcgctgatgtcgtcaggaatatgcagctcaacgtaacggctgatgaagttaccccacagcggcccggcaataatcattcccggaattgccgcacacaggccaatcaggatcatccagccaaagtcggcattcatctgcgatgccagcagcatcggcgctggtccaggcaccagaaatgccgccgctgccgccacgcctgcaaataatgggattaccagcttcaccaggttcgtaccggtgtggcgcgccattgagaaagcaacgctaatcagcagaactatcgccacttcaaagaacagcggtagcgcacagaccagccccgcaaggccgatggcataatgcgcgcggctgtgaccgaaggatttgagcattttgacggcaatctgatcgactgcgccggtttcatgtaagatcttgccaaacatagctcccagggcgacaaccaccgccaggaagccgagggtgcctcccatccctttttccatcgtcgctgcgattttatcgagcggcataccagaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcgatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaaatagatgaaagagagattcggattaccttcacgcagcaagtcgcgatagtgttttttcaatgcagaacagacgatcagcgacactttattagtgcgctgcatagcaaacgcggcgtcgttcagcgcctgcaaccacggtttgcgatcgtcgtcattcagtggttcgccagacgccattttttcgatattgcgccgtggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccatgccttaagtgtataagtgtgagctacttcaaatttgtgggcttaaatagatccgcccggtgacaaggtgaaacctaaatctaacattttcggtgtcacagattcgccacgaatacgcgccagcaggcgttcagcgccaatactgcccatccgctcacgcggcgtcagcacgctcgcaagtcgtggctccatcacctgaccaatgtcatgaccgtggaaaccggcaatcgccatatcgtcaggaacttttaaccccagacgctgacattcaaacgccgcgccgaccgccaggtcatcattcgtacagaacacgccatccagctgcggatattcccgccgcgcctggcgaatcagttcaataccggaagagtaagaagaagattgctcaaccatcacgctatatggcaccaggcctgcatccagcatcgcctgttcgtatcccttctgtttgatgatagtacgttcgtcgagacgtgcgccgagataggcaatgtggcgatgcccgcgagcaataatggcagtggtcatctggcgtgctgcttcaaagttatcaaaaccgacggcgatatcaaggcatggcgacttgctgtccatcagttccaccacgggaatacccgccacttcaatcatctttaaggtgcgcggcgtgtgggtacgttcggtgaggatcaggccgtcgatattccaggagagcatggattcgaggcgttcttgctccatttccggtttataaccgtagtgcgccagcatggtctgataaccgtgcgcgtcggtgacgctttcgattccgcgtaatacttccgcgaaaacctggttggtgagagaaggtaacaggacgccaatcgcccggctggtggcgttagagaggatatcgggcgcacgattgggaatatagcccagttcatcaagagccgcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacacatcagaaccttcccggggaaaacagtgcttgtttacaattattagatatacactaaatcaattgcatcgcattgtgctaacgacgcggcaaaaccccggaagcgtacatcagcacgcgaccggagcgagcgaggaagcctgcaaaaaggcaggcttcaaagatgccgttgagttttaaaccggcggcagatcgaacagtaacacttcgctgtcgctatccgcatggatggagattgcctgctcatcccagattgccagaccatcgctggtcgaggctttcacgccgttaatggtgacattgcctttcaccacctggatccagacgcggcgttcagcggcaatctgatgcaccgactgctcatctttcagcaacgcccagcggtacagttccatatcctgatgcactttcaatgaaccatctcgcgcatccggcgagagcaccagctgtttgccctgtacggcatcgaagcgacgctgttcataacgcggcgtaataccgttttcttcaggcatgatccagatctgatacagatgcagacgctcggtgctgcttgggttgtactctgagtgacgaatacccgtaccagcactcataatctggaactcacccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcggagaagcccataaagttcggatcgtaatagttggcaaaagagaaagtatgccaggagtccagccagccatgatttgcatgaccacgttcatttgctttgcgtaagtagatcatttgtattcgccccctgaatgatttcgatgggcttagtgtggacccgatctgcctgggatgatagagggtgaaaattgacccctctgttcaaaaaaattgaactattcgaggggccatcaaacttacttagcgagagttactgtggagggagaggcttgctcaaatccgcgttcaaggatttccagattggtaagaacttcagattccttgacgtaatttggcgcaccgtgggtgatggtttgatacaacgcatcataaacgcgcccgtaatcgcccatctccggcttcatctcttctctgaccgtcacgccctcgtcattgacatactccagcacaccgaccgaatcatccgctgcgaatcccggttcgcccggcataatattagccttcaggctggtttcctgctggtcgataccgtatttaataaacgaacctttcttaccgtgaacgataaatttcggataatcgattttcaccagatggctggttttgacgatggctttcaggtcgccataaaacagttgcgcttcaaaggtgtcgtcaggattggctttattacgcaggctgcggatgtcataagcgacgtgatccgggcgaccgaacagagaaataatctggtccatcgtatgcacaccaaggccataaaacgcgccatcctgcggcagcccaggtttggtttctgccaccgggcggtaatagtcaaaatggctttccacttcaacaatctctcccaacttgccactttcaatcgcttttttcgctgtcaggaagcaggagtcaaagcgacgattctgatacggcgtgacggtcagccctttgcttttcgccaacgcaaacagctctttcgcctgcgcaagtgtcggagtgaacggtttttcgaccagcacatttttcccggcttccagcgcgcgtttcgcgtactcgaaatggctgtccgcgtgggtgcagacaacaaccagcttaacatcgggatcgtttagtacttcgtcgagatcgctggtgaaatggatatgggaataaatgggagcctgttcttccggcttcgcatggcgacgaaaaatatgcgcgacatgccagctatccttgcggttaagtacatacggcagatggtaacgggtggtgcttttgccgaagccaataaaggcgcagttgatgaccatgatttcgtcctttttaaggtggttatttacaccttagcgcaaagcggacgtggttcctactggagtgcgcataacgaacacaagcactcccgtggataaattgagaacgaaagatcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgggattacgaggccatcaggcagattcacgcccagccggaggtgtattgcaacacactacaggtgcctcatccttccgatcatatgtggcaggagcgactcgccgatcgtcccggcatcaagcaactcgtcgcctgtattgatggagacgtcgtgggccatctcaccattgacgtgcaacagcgcccacgccgcagtcatgttgccgattttggtatctgtgtcgactctcgttggaagaaccgcggcgtcgccagcgccctgatgcgagagatgattgaaatgtgcgacaactggttgcgggtagatcgcattgaactaaccgtgtttgtcgataacgccccggcaattaaggtctataaaaaatacggctttgaaattgaagggactggtaagaagtacgcattgcgtaatggtgaatatgtcgatgcatattatatggcgcgggtgaagtaagatagtgccctttttctgagatggaaaaagggtgtcattcaaaatcgacataccttcctttaaggtatttatttgcccaatacatatattgagatttaactcataattacttcctaaagtgtaatattttattttttaatatatacgcctacaatttcctggagtaaataaataacaattaacaagcataatattgccattgataaaatagcatgccataaaaggacttttcagggatgagtaatattgtttacctgacagtaacgggagaacaacaaggaagcatctccgcaggttgtgggacttctgagtctacaggtaatcgttggcagagcgggcatgaggatgaaatatttacattctcactcttaaataatattaataatacggggcttggttcacagttccatggtataacattttgtaaattaattgataaaagcactccattatttattaattccattaacaataatgaacaattatttatgggatttgacttctatcgaataaatagatttggtagattggaaaagtattattatatacaactaagaggcgcttttttatcggctattcatcaccagatcattgaaaaccaactggatacagaaacaataactattagttatgaatttatcctctgtcaacatcttatcgcaaataccgagttcagctatttggcactccctgaaaattataaccgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttctaatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctggaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatgcaatcacgaatagctaagggaatattagtaggtgaaagcaaaatcactccctgggccattccatctggctcaatttatcctcccatgaaaaatattatggaccacacaaaatgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggattatagcatttcaatatttacttatgacattaaaggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccgacattaaaagtaacttttttgaaattagagataatattggcacagaaaatatattcagttcgtttagtgatttctcttcattcttaaacgaaatcatggacagttgttcataataatcaaaaggaaacaaaaatcattgtaaaccatgccatctttttagagattaccagcagaaaattccttgttcgaaatttagcagtgcaagctatggaaaaacttacaacggaactacactccttaagtgagatggaccgaagacatgtagtctctattttagccgaaatagctaatggctatgatgattttaatgacatgttgatttatttagaattttacccgaatcataagattctgatatcttaaataagaaaatcccgttcgacgttctgaaaaagaaatcataaaatattagcagatacttatttcgtgactatatcttatccgatgaacttttttcaaaaccagcatttaataatatctttgacgaagatgaacgcgtctttgctcaatgtatcacacaggaataataatataacactcaacaataatatttattataattatgattacttatcacgacgcattcgcgaaagcgaaccattaccttgatgatgcagatctcccggtcgtcattactctacatggacgctttagccagggctggtatttctgtttcgaagcacgagaatttctcgaaactggagatgaggccgcgcgcttagctggtaacgcaccttttattattgataaagacagtggtgaaattcattctctgggaacggcaaaaccgctggaagaatatctacaggattacgaaataaaaaaggctaccttcggcttgccctgacaaaatagccctcttcccacgaagagggccgctaaccttagtaccccgccgttaaatcatccaccgagcgcgggtcggatgcgccgtacaactcaccgtccggcccaaccataatgctttgtgtactgcccatcgcctctttcagcgccactttctgaccttttgcttccagcagcttgagcgtatccgggctaaaccctttttcgacacgcagctcgtccggcaaccactgatggtggaaacgcggcgcattggtcgcttcggcgacgttcaagccataatcgatgctattcaccaccatttgcagcactgtagtgatgatccggctaccgcctgggctaccggtaaccagccaggttttaccgtctttcaccacaatggtcggcgacatcgacgacagcgggcgtttgttcggcccgacggcgttggcatcaccgcccaccagcccgtaaacgttcggtacgcccggtttggcggagaaatcatccatctggttattaagcagaataccgctctcgcccgcgacaatgcccgtaccgaaggtggtgttcagcgtataggtcaccgccaccgcgttaccatctttatccaccactgagtaatgggtagtttgattactctcataaggcgcaagcttgccggggcgaatttcgctggatggcttcgctttattgatatcaatttgatcggcaatagatttggcataggctttattggtcagcgcctgccacggtactttgacaaaatccgggtcgccaagatattccgagcggtcggcgtaggcgtatttctccgcttctgccatgatttgcatcgcatcggcgctgccaaagccgtatttcttcatatcgaagttttccagaatattgaggatttgtacgatatggatcccgccggaggatggcggtggcatggagtaaacctgatacccgcgataatcgccgcttatcggagtgcgttcgaccgctttataggctgctaaatcttctttagtgatcaagccaccgtttttctgcatctcctgggcgatctgttccgcaatcgtgcctttatagaattcgtccgggccgttttcagcaatcatctccaggctctttgccaggttcgcctgcaccagcgtgtcgccctttttcagcggctcgccctctttccagaagatagctttactgttttcgtgattcggcaacacttcgctaccgtaggttttgagatcgtcagccagcgcgtcgttaacgataaaaccatcgcgtgccagtttaaacgcgggctgcacgactttgttcagcggcatggtgccgtatttatccagcgccagcgagaaacctgctaccgtacccggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggattaacataaaaccaccaccgcccagattccctgcctgcggatgcgttaccgccagcgcgtagcccaccgccacggcggcatcaacggcattcccgccctccttgagaatatccacccccacctgagtggcagtggcgtccacagacgctaccattccctgtttcgcgcgtaccgggtggaagacatcttcctccacaccatacgagacgggcggcgcaggaggcgcggcggcggcgctaaaacaacttcctgagagcagagcagcaatggccacccggcgtaaaaacgtcggttttatcatcgttattctccagagattaaggggcaaccccagctaagcctggtatataactctgaattaatcatcgttttgtcgggaagcgagtaaacttaaaggatatcttcagaggaggatacgcgatgaaacgacttctgattcttacggcactcctgccgtttgtcggctttgcacagcccattaatactctgaacaaccctaaccagccggggtatcagatacccagccagcagcggatgcaaacccagatgcagactcagcaaatccagcaaaaagggatgctgaatcagcaactgaaaacgcaaactcagttgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacaccccagcgcagcaactctgctgcgcgctggggtttattgacggtataaaccagaatccgcagtccggcgtctttcaactgcatcactcgcgctttattgagtaacttatgattgagatgaatagagacgcagcccagccgcgcggtcagttcgcgccagtcgtcgcgccactcatccagcaacaaaccgcgcggcagttccggtgccgcctgttgtgcagcttctaaagcatcaatctcaaacgatgacagcagcggcggcgtcataccggcccacagctcgcgtgccgccagcgccaccattttgcccgttaatggcccggtgccggtggtgggtttgatttcgatattcgccatcatcccgtgttcgcggcaacgttccgccacctgcgaaagcaacggtagcggctcacctttaaacattttgctgtaccaactgcccgcatccacgcgcagtaaatcctgccagttcagttcacccgcgacgccccagccgttgctggtacgttcgagattgtcgtcatggagcaggaagatctcgccatctttcgataacttcgcgtcaaattcgatcatcttatgaccgtattttgccccgacgtcgattgacgccagggtgttttccggggccagcttaccgccgccacgatgagcgacgatgcggggataaggccagttactcatactcgttgtcctgtttcaccatcaaaaagatgcagctgattttccgccagatgcagccacagcgtgctgcctgccgtcgggcgctcctgatgcgccagtcgcaccaccagcttctgctcgccccagcgtccgtgcgccaggttatctgcgccgaggatctccagcgtgtccatcaccatcggtacgccgccttctgcctgcgagcttagcgcaatatgttccgggcgaatgccgagagtcattttacgcccggcatactgacggtagccaccgtttagcggcagctcaataccgccgtccagttcgaaatgcgtgccttcgttattcacgcggcctgtcagcaggttcatcgccggactgccgataaaactcgctacaaacaggctggcgggcttttcgtagacttcaactggtgtgccaatctgttcggcaacaccgccgttcatcaccattactcgctgggcgagcgtcatcgcttcaacctgatcgtgagtaacgtagagtgaagtcgttttcaggcgacggtgcaactgttgcagttcaagacgcatctgcacgcgcagcttggcatcgaggttagagagcggctcatcaaacaggaacaccgccggatcgcgcacaatcgcgcggcccatcgccacacgctggcgctgaccgccggaaagctcgcgcgggcgacgtttgagcagaccgtccagctccagaatgcgcgccgcttctttaacgcgctcggcaatttgctgcttgcccatgccgcgaattttcagcccccacgccatgttttcttcgacactcatatgcggataaagcgcgtagttctggaacaccatcgcaatcccgcgatcttttggctccatttcagtcacgcgctggtcgttgatccagatatcgccttctgtcacccgctccagcccggcaaccatgcgcagcagcgtcgatttcccgcagccagacggcccgaccatcacgataaattcgccatccgccacatcaagggtcagcggtttaatgacctgggttttaccatcccagcttttggttactgcctgtaatttcagtcctgccatcttatttctcactatcgaccaggccgcgcacgaaggcacgctgcatcactaaaacaatcaccaccggagggataagcgttaacaacatcgccaccatcactgagttccattccgtggtgccttcgcctgtagcgatcatccctttgatccctgccacggtggtgccgagatccacatcggtaataatcaacaacggccacaaatactgattccagccgtagataaaggtgatcacaaacagcgccgccagattagttttggagagcggaaaaacgatgtcgcaaaagaagcgcattggcgatgcgccgtcgatccgcgcggcttccaccagctcatccggcagcgtcataaagaactggcggaacaggaaagtagcggtcgccgaggccatcagcggcagcgttaaaccggcgtagctgtcgagcatctgcaggttggcgatgacttccaccgtcgggaagatacgtacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgttcacccagatgttgtggatgttttccagcagatgtgtgccggggatgagcgtcatcggcgcggcatagacggcctgtttatccagcgtcgccgcgacaaacgccacgtacagcgggaagaggatcaccgcgatcccgaggatcagcatggtatggctgaatatcgtcagccacggacggttctcaatcattggtaacgcaccttgctttcaacatagcggaactgcaccaccgtcagcacgatgacgaggaacatcaacaccaccgactgtgcggcagacgaagccagatccagtccggtaaaaccttcgcggtagatcttataaatcagcgtcgtggtggcctgaaccggcccgccggacgtggcggcgtcgatcaccgggaaggtgtcgaagaaggcatacaccaggttcactaccagcaggaagaaactcaccggggcgataagcggcagcgcaatcttaaagaagcggcgaatcggccctgcaccgtcgatggctgcggcttcgatcaacgaacggggaatggattgcagcgcggcatagaagaacaggaagttgtagctgatttgcttccatactgaggcaaacaccaccagaaacattgcctgaccgctgttttgcgcgtggttccagtcgtagccgaactccgcgagaaaatgggtgatcagcccgcgaccggggttaaacaggaagatccacaatacggcggcaacggcgggagccacggcgtaaggcagcaacattaaggtttgatagaaacggctgccgcgcacgatgtactccaccagcgccgcaaagaacagcgataccagcaaaccgctgacggtgacaaaggtgctgaattttatcgtcgtccagaaggagtcgagatagtagctgtcatggaacagcgtgacgaagttatccaggccgacaaactggctggagaaaccaaacggatcgacgctttgtagcgagtaccacaacgcttcgcccgcaggccagataaaaaagataacggtgatgatgagctgcggcgcgaccagcagataaggcagccagcgcgagcggaacaccggacgggatgatgacattacggttaattcctgaactgtgccggatgcgcttcgcttatccggcctacacgcgatgccaggtcagataagcgaaacgcatccgacattacactgattaagacttcgtcgatttctcaaagcggcgcagcaactgatttccacgctcaacggcggtatccagtgcctgctgtggtgtcttcttaccggtccacacgctctccagctcttcatccacaatcacgcggatctgcggcatgttgcccagacgcagccctttggtgaacggcaacggcggcttattcagcatctgacgcgtcgcggtatccgcccctgggtttttctcataaaagccctgctcacgggtcaggtcatacgctgctttggtgattggcagataaccggttttctgatgccactcggcagcgttttctggcttcgcgaggaaatcgaggaacttcgccacaccggtatacgtttctttatctttaccctgcatcacccacaggctggctccgccgataatggcgttttgtggcgcatctttcgcatcggcgtcgtaaggcatcatgcctacgccgtagttaaatttggcgtactcgcgaatgttggcaagagaaccggaagaggcggtggtcatcgcgcaatcaccgttatagaacttctcggtggattcatccttacgaccgacgtagctgaagtcgcccttcttgttcatctcctcgagcatggcgatgtgtttcacctgctccggcttattgaactccagcaccgcgtccgtgccgtcaaagccgttgtttttgctggcaaacggcagaccgttccaggcgctaaagttttccagttggatccagccctgccagccgctggcgtagccgcacttcatgccggaggctttcagtttcgcggcatagtccgccagatcctgccaggttttcggcggctgttccgggtctaatcctgctttcttgaaggcgtctttgttgtaatagagaacgggggtcgagctgttgaatggctgggagagtaagtggcccgttttgctgtcggagtagtaacctgaaaccgtcggcacaaactgcgactcatcgaactgaatccctgcctctttaaacacgtcatacaccggtttaatggctttcgacgccatcatggtggcggtgccaacttcataaacctgcaaaatagccggcgcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgtgcattccccattaacgccagtccgagcgccagtgctgaagctgtataatgtaacggtttcatcgtttatctctcttgttgtaccgaatgcgcgaattcacgcgttttatgctcgcggggtaacatgacatgctcgaattacagaaaaataacttttttgttacatttgtaagatagtaaggtgtcagaaagatgacaaggcggtgacggcgtgggtgagggaaaatgggagatggggcacggataagcgggaaaatatagaaggtctgaatcaaactctacagattgctcatcgtttcatgccggatgcggcgtaaacgccttatcaggcctacaagatcgtgcaaattcaacatattgccactcacccagtaggcctgataagcgcagcgcatcaggcaattttacatttgtcacctgtctcaaaggagtcttttgactccctatcaatcaacgtgttattacccgcctaaatacgcacttctcaccgcttcattcgccagcagcgcatcaccagtatcggaaagcactacatggccgttttccagcacgtagccgcgatccgccagctttagcgcctggttggcgttctgctcgacgagaaagatagtcatcccctgctcgcgcagctgctcgatggtgtcgaaaatttgctggatgataatcggcgcaagaccgagcgatggctcatcaagcagtagcaaacgcgggttgctcatcagcgcacgaccaatcgccagcatctgctgttcaccgccggacatggtgcccgcccgctgaatacggcgctcatgcagacgtggaaacagctcatacacccactttatgcgctcctggaactggtcgcgttcagcaaaaaaaccgcccatcgccaggttctcttccaccgtcatccgcgagaagacgcgacgcccttccgggacaatcgccaccgcttcgcgcatgattttcgctgtctgccagtcggtaatgtctttatcatcaaacacaattcgcccgctggtggcacgcggatcgccgcataacgtgccgagcaaggtggttttccccgccccgttcgcgccaatcagcgtgacaatctcgccctgattgatatgcaggctcacctcatgcagcgcctggattttgccgtagtgggcgctgactttgtcaaaggacaacatgactttttccatcttatgcctcacctaaataggcacggatcacgtccgggttattacggatctgctccggcgtaccgtttgccagcggcgtcccctgattgaccacgtaaattcggtccgaaattcccatcaccagcttcatatcgtgttcaatcaacaagatagtggtgttgtgatgattgcgcagttcggcaatcagctcatccagctctttcgtctctttcgggttaagacctgccgcaggttcgtcgagcattaaaatctccggctgcgtcaccatgcagcgggcaatctcaagacggcgctggtcaccataggccaggttactcgcctgacggttggcgtgttccagcaaaccaatgcgctcaagccaggtcgcggcgcggtcgagcgcttcgctctgggcgcgacggaaggatggcgttttcaacaggccagagaacagcccggttttcagttgctgatgctgcgccaccagcaggttttcaattaccgtcatttcacggaacagacgcacatgctggaaggtgcgcaccacgcccatgcgggcaatttgctgccccggtaaaccttccaggtgctgatcgcgcagtaaaatggtgccgccggtgggtttgtagaatccggtcagacagttaaaaaccgtggtttttccggcaccgttagggccgattaacgagacgatctcctgcgggtacagttcaagattgacgttgttcaccgccagcaggccgccgaagcgcatcatcaggccgttaacagataataatggctgactcatgcctgctctcctttcgctgcgccgtttttcagcttcagttgcgggcgcgtcatgggcagcaagccctgcggacgccagatcatcatcagcaccatcaaaccaccgagcattaacatgctgtattcgttgaaatcacgcatcaactcgcgcgacaccaccagcaaaattgccgccagaatcaccgcaaattgcgagcccataccgccgagcaccactatcgccagcacaaacgccgattcggcaaaggtgaaggattccgggctgacaaagccctgacgcgccgcaaacagcgttccggcaaaaccggcaaacgcggcacttatggtaaaggcagtcagcttgatacgacgcgggcttaagcccagcgaacggcaggcgatttcatcttcacgcaacgcttcccacgcacgccccagcggcatccgcagcaggcggttaatgacaaacaggcttagcaccaccagcagcaacgccaccaggtagaggaagatgacacgatcggagggatcgtatttcaggccaaagaaattactgaacgtgtcccagccgccttcacgagcggtacggctgaactcgagtccgaagagtgtcggtttcgggatctgactgattccgttcgggccgccggtaatttcggtgttattgagcagcaatatgcgcacaatttcgccgaaaccgagggtaacgatcgccagatagtcaccgcgcaaacgcagcaccggaaaaccgagcaggaagcccgccgccgctgccattaatccagcaatcggcaggcaggtccagaagcccaagccgtaatagtgattgagcagcgcaaaagtgtaagcgccgatggcgtaaaaaccgccgtaccccagcaccagcagaccagaaagaccaacaaccacgttcagcccgagaccgaggataatgtagatcatggtcagggtggcaatatccaccgtcccgcgtgaaaccataaacggccacgccaccgcaagcaccaacagcgccacgaggaacagtttctgcttcaccgtggagccatcaatggcgggcagaataaacttcggtccggaaacgcttttcaaccctttctggaaagccggtcgcaaaagctggaagaaaaagaccaccgccgtgccgataaacacccactgccaacggacatccgaagccgtgtcgaccaccagtttggtgccatccagctccagttgcacgcccataaagacgcccgccagcacaaagaacatcgcggcagagagcagcgccattgcaatatgcatcggtttcatactttctctacctccgggcgacccagaataccggtcggcatcaccagcagcaccagaatcagcagggcgaatgagaccacatctttatattccgtactcagataggcagaagagagcgcctccgcaatccccagaatcaggccgccaatcatcgctcccggaatgctgccaatcccaccgagcaccgccgcggtaaaggctttcatcccggccataaagccgatgtaggggttaatgacgccgtagaactgaccgagcagcacacccgccaccgccgccatcgccgcgccaatcacaaaggtcagcgcaatcacccggtcggtgttaatgccaagcagactcgccattttcagatcttccgcgcaggcacgacacgcgcgacccatgcgggaatagcgaatgaaaatcgtcagcgccagcatggcgaggaaggtaacaatccagatcaccgcctgcatggtggtaatagaggcagagaagttttcgctatgccccaccacccactgaccgttaaacaggctcggcagcgccacgtcgcgcgaaccttcggtcaggctgacgtagttttgcaggaagatggacataccgattgcagagatgagtgcaatcaggcgcttagagttacgcaccgggcggtaagccacccgttcgatactccagccgtaggcgctggcaatgacgattgcgccgacgaatcccgcagctaccagcagccagccggtatcaatgcccatcatcatcagcgcggcgatgatcataaatgagacgtagctgccaatcatataaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgcattttacgggcggtgggatgatcacttggctgccgtggatgaaccgtcggcgtgccactggaagacaccaaaatcaaatcccttaagatcgcctttttcatcccagttcagcggcccaatcacggtgtttgcaccgttagcttttaaatctttcaccagcgccagcggctcatcgctgccggtacgctcaagggcagtcgccagagattgcaccgccgcgtaggtgatccagacataaggcccggacggatctttcttgtctgctttcagcgcatcaacgatgccctggtttgccggatcctggtcatagcgttttggcatagtgaccaacatgccttcggcggcatcaccggcaatgttcgacaacgacgcattacccacaccttccggccccataaactgggttttcaggccaacggaacgggcctggcgcagcatctgccccatttccgggtagtaaccgccgtagtaaacgaagtcgatgttttcttttttcaggcgggcgatcagcgcggagaaatctttctccccggcggtaataccgtcgaagaagacgacgttggcgttagccgctttcagcccgtcctgcaccgaacgcgccagcccttcgccatactgttgtttgtcgtgaatgatggcgatgcgctggggcttcaccgtctcaagaatgtattttgccgccgttggcccctgggaagagtccagcccggcagtacgcataatgtgttgataaccgcgttgggtcagctccgggttggtcgctcccggcgagatcatcagaataccttcgtcttcatagatatctgacgcaggctgggtagaagaagaacacagatgaccaataacgtatttaatgccgtcattaacgattttgttggcgaccgcaacggcttgtttcgggtcgcatgcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgccagtgcaatcatccctgcgatgatagttttcgcattccgtttcatagtcaaaaatccccattcgtgatgttgtgttgctttgtttttatgtgttaacaaatcagactgttctttttttatactgcactgtttttgcctgtctgattaaggggttagcgcagtattttgtgataatagcgattaaaatccctatttttcagtcgattaagaacagataatattctgaatttattgatagataaacagaaaaaagtgcctttgtcagcataaaataacggcacaaagggcggaataattcactatcattcaggggattatgctggacatttttcattctctaatgttttaattttgtaattattgctgttaaaaaattaatcacctgccaaaagaaataaaaaagagaaagcctccgattaaattatttcgctacactggttccacttttgtgatttacacgggttacccatgaagctgaccatcattcgattagaaaaatttagcgaccaagaccggattgacctgcaaaagatctggccggagtattccccttcctcgttacaggttgacgataaccaccgtatctacgccgcgcgttttaacgagcgcctgctcgctgccgtgcgggtaaccttaagcggcaccgagggagcactggattccctgcgcgtgcgggaagtcacccgccgtcgcggtgtggggcaatatctgctggaagaggttttgcgtaacaatcctggcgtttcatgctggtggatggcggatgcaggcgtggaagatcgcggtgtgatgacggcgtttatgcaggcgctggggtttacggcacaacagggcggctgggagaagtgttaatcgtcaagtttgatttcaaaagtgatattgcctgatgcgctacgcttatcaggcctacaatgtgtgttgcaatttactgatttctttggatcttgtaggccggataaggcgtttacgccgcatccggcatgaagcaacgtactcgatattagcaatttggcggcaacccaaagttgccgattaatgattacttcgcatcggtcgccgtgccgttggcgtgccagtcaaatacgccgaactcaaagcctttcagatcgcctttctcatcccaggtcagcggtcccattacggtatccacggagttcgctttcaggtatttggcgatttcagccggatcgtcagactgattcaggcccgcctgcaaagattgcagcgcggcgtaggtggtccaaacgaatgcgccacttgggtcctgttttttcgctttgatcgcgtcaacaatgggtttgttcgccggaacctgatcgtagttcttcggcttggtcaccagcagcccttccgctgattcgcccgcaatgttagacagcgaaacgttagccacaccttccggccccataaactgagttttcagccctgccgcgcgtgcctgacgcaggatttgccccatttccgggtgataaccgccgtagtaaacgaagtcgatattctcttttttcagacgcgccaccagcgttgagaaatctttttccccggcggtgatgccatcaaagaacaccacgtttgcattgcctttcttcaggccgtcctgcaccgctcgcgccagaccttcgccgtattgctgtttgtcgtgaacgatagcaatacgctgcggtttcactttctcaagaatatatttcgccgccgtcggcccctggtcggagtccaggccggtggtgcgcaggatcagctgatagccacgggcggtcagctccggcgcggttgccgctggggtgatcattaaaatgccttcgtcttcgtagatgtcagacgcaggctgcgttgatgaagaacagaggtgaccaatcacatatttaatgccgtcgttaacgactttgttcgccaccgcaaccgcctgtttcgggtcacaggcatcgtcatattttacgatttgcagtttgttgcctttaatgccgcctttagcgttgatatccgcaaccgcctgctctgcgccggtaaactcctggtcaccgtactgcgcaaccggaccggacattgcgcccacgaccgcgactttaatatcttctgccagagccatattgctgaatgccagcgcgatacatcctgccagtaacgctttaccctttatgttcatcctgagaatccccattcttctggttattacgtgtgttgtgatgttgtttttcagcactttatttcgttttatgcatgactacccgtgctttagcagcatactctgctaaaacatacccgatttttatgatattggaatagctattttgacagtttattaacaatctgcgtggggattggcgttttgccggaggggaaattgattattacagaggcccaaaaaacaaaaaccccggactctcatccagggttctctgcttaatagcggaaattacgcttcaatggcagcacgcaattttttcatcgcgttcttttccagctggcgtacacgctcagcggaaacgccgtaacggtcagccagttcctgcaacgtggacttgttgtcttcgtccagccagcgcgcacggatgatgtcctggctgcgttcgtccagaccctgcatcgcgtcggtcagacggtttgccgcctgctcttcccagttatcatcttcaatgccgtcggcaaagttagatgatttatcctgcagatagagcaccggagccatcggctggctgtcggaatcgtcgtcggaagacaggtcaaaggtcatgtcctgtgccgccatacgtgattccatctcacgtacgtctttgctggttacgcccagttcacgggccaccatttcgacttcatcctggttaaaccagcccagacgctgcttggttttacgcaggttgaagaacagtttgcgctgcgctttggtggtcgcaactttgacgatacgccagttacgcagaacgtattcgtggatctctgctttgatccagtgaacggcgaaggagaccaggcgcacacccacttccgggttgaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaatagcaggcattcatcgaatgataagccattgatatcaaacttcgttccgaaaacctgtgccacttccgcaaccgccgatgacaatcgcagcaccagaatttctgacaaaattaatgacaacaatgcgccagaaaatcccagcagtgcgccaccatacaggaacgggcgcaggatgaatccatctgtcgcaccaatcagtttctgtacgttaatggagtcacggcgagcaaagatactcagacgcacactgttaccgatgacgaggaacacggccgccaccatcaacacgccgatcatcgccgaaacgcgcccgaccagcccggtcaacgccgccagacgggcaaaccagctgtcatccatccgcacttcgtcaatgccgttaatctgcgtgatacgatcacgcagcgtattcagtgattccgtcccctggaaatcgagtttcgggatcaccaccgccactgccggaagcgggttttcttccagcatatccagcgcaccaccaaaaccagaccagttacggaactcacccagtgcgtcttcacgagaaagatagttcactttctccacgccttgctcggcctgcaactgtgccaccacgcccgcagcagcgtcatcgtccagcgttttttgcagataaacagtgatttgcggtgacggataatactgcgtcgccgcctggttaacgtttttgtacaccatataacagacgctgggcagcgtcagagaaatggcgataaccatcaccgttaaaaacgtggcgaacggtttgcttttcagatcctgcaatgcgccgtggaaggcatagcgcacctgttcgttgaaaacgttggttttgcgatttaccggttttggcgaggatttcgcgcgttttggtgcgttacgaccgccgtcgcctgagccgccgaccgatttacggaagcgatcaagacgcccgccaaactgccgaatatgattgattgcatcgcgcttattcatggcccacgcctccatgcaagtgaccatcgctcagggtgagcatgcgataggaacgccgcgagatcaggttgatgtcgtgcgttgccatcaatacggttaccccaacgcggttaaactcttcaaacagacgtaaaatgccttccgacagcgcgtcgtccaggttaccagtcggttcgtccgccagcagtaccgcgggcttgttcaccaccgcgcgggcaatgccaacacgctgttgttcaccgcccgaaagctgaatagggaagttcttcgctttgtccagtagcccgactttatccagcgccgccgacacccggcgacgaatatcgtcaccgctggcaccggcgataatcagcgggatcgccacgttatcgtagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcatggaacagtttggcctggcttaccgcgttctgcccggtgctggcatcaatagtcagcataacttcatgcggcgcttcaacgtcgagtttcttcatcacgcggacgattttcttcaactcttccatcaggtgcgatttgttctgcaggcgtccggctgtatcggcaatcaggacgtcgatattacgcgctttagctgcctgaatggcgtcgaagataacagaggcggaatccgccccggtatgctgggcaatcaccggaatattgttgcgctgaccccagacctgaagctgttcaaccgcagctgcacggaaagtatcacccgccgccagcatcaccgatttaccctgctgctcaaactgacgcgccagcttaccaatcgtcgtggttttacccacaccgttgacgcccaccatcaggatcacaaacggcgctttgccttcaacattcagcggctcatcgactttcgccagaatctcgcccatctcttctttcagcaggccatagagcgcctcggcgtcacgaagctgcttgcgggatgcgccttccgtcagattggtgataattttacgtgtggtttccacacccacatcggcgatcaaaagctgctcttccagctcctcaaacagatcatcgtcgatttttttaccgcggaacaggctgataaatccggaaccgagattttctttggtttttaacaggctgcgtttcaggcgcgcgaaaaaaccttctttggtcggtttttcctgctcctgagcgatttcttccaccggctgctcttcttctgccggaggaaccaccatcaccgcctcttctgccgcttcggcagccagcgccgtttccagctcttcgtcggtaatttcttctttagccgcttcttcttccgccgcttcgacaatctctacggtttccgcttcagcctgccactcttctggcgaaaccgcttcggcgttgacgtcttccggcaacggcagctcttcacgttcgatagccactggctccggcgtttcttctacgaccggttccggctgtgcaacgacttccgcttcaggctgcgctttttcactttcagcaacctgttcagtgacttccacaacgtcggcagcaaaagtttccgcctcggcttcagtatgcgcttgcggctgctcttcaacggcttgttcagaggccttcacaggctcttgcgcctgaacgatttcttctacaaccggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagcccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggcaacgttgattgagatggatcgcgcggtttctcagcagttaattaagaatctggcgacactaaaagcaggcaatgcacgcgtggtgaacagcaacgcgatgtcattcctggcgcaaaaaggtacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccagcaaactggtcattacatcgggaaaaagtggcgggtcaggtggcttatcggctgtatcaacgcgaagcacaaggagaaagtgatgctgattaatattggtcgtttgttaatgctctgcgtttggggatttttaatcctcaacctggtgcatcccttcccacgcccgctgaatatcttcgttaacgtggcgctgatttttaccgtgctgatgcatggtatgcagctggcgctattgaaatccactttaccgaaagatggcccgcagatgaccaccgccgaaaaggtacggattttccttttcggcgtgtttgaactgctggcctggcagaagaaatttaaagttaaaaaataaccttattgttcgcctacaaagctgacaaagcgcgttcctttatagctcagcgtacctttatcgcccactgtcagggcgtggtactgctgggcgtcgaggcgaaacgtctgctccattcctccgctttgcggtttgaagcttgcctcatagcgtatactggtgcctgccggagtcacttcctgctggcgcgaacggcgatcgttaatcggtttttcccgcttgttgctcaccaccaccagcttttgctggagcggagccatatcattatcagctttttcccgtcgctgttgcataaaacgaaacgatgcggcgacgacaattaagccaatgataacaataaagaaaagaggtggtttgctcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttactggcctggcaagcgccgatgttcgacgccattagctatctggtgctggcagggctgtgcgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctaccactggtgctgctggttctgggtgcgctgttactggcgattatctggacgcgcctggaagagtaccgttggcctatctgcacgtttatcggcatgacgctggtgatggtgtggctggcaggtgaactgtggttcttccgtccgaccgctccggcgctctctgcgtttgttggcgcttcgttgctgtttatcagtaactttgtctggctggggagccactatcgccgacgcttccgtgcggataacgcgattgctgcggcctgctactttgccggtcacttcctgatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaaccacggtacagaacgccaacgactgttgctgcgacggcgcatgttccagcacgccaactctctctgaaaacgtctccggcacccgctatagctggaaagtcagcggcatggactgcgccgcctgtgcgcgcaaggtagaaaatgccgtgcgccagcttgcaggcgtgaatcaggtgcaggtgttgttcgccaccgaaaaactggtggtcgatgccgacaatgacattcgtgcacaagttgaatctgcgctgcaaaaagcaggctattccctgcgcgatgaacaggccgccgaagaaccgcaagcatcacgcctgaaagagaatctgccgctgattacgctaatcgtgatgatggcaatcagctggggtctggagcagttcaatcatccgttcgggcaactggcgtttatcgcgaccacgctggttgggctgtacccgattgctcgtcaggcattacggttgatcaaatccggcagctacttcgccattgaaaccttaatgagcgtagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaagggtgagcgggaagaggtggcgattaacagcctgcgccctggcgatgtgattgaagtcgccgcaggtgggcgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtgacgttggaagtgctgtcagaaccgggagccagcgccattgaccggattctgaaactgatcgaagaagccgaagagcgtcgcgctcccattgagcggtttatcgaccgtttcagccgtatctatacgcccgcgattatggccgtcgctctgctggtgacgctggtgccaccgctgctgtttgccgccagctggcaggagtggatttataaagggctgacgctgctgctgattggctgcccgtgtgcgttagttatctcaacgcctgcggcgattacctccgggctggcggcggcagcgcgtcgtggggcgttgattaaaggcggagcggcgctggaacagctgggtcgtgttactcaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcgcaagccatcgtacgcgaagcacaggttgctgaactcgccattcccaccgccgaatcacagcgggcgctggtcgggtctggcattgaagcgcaggttaacggtgagcgcgtattgatttgcgctgccgggaaacatcccgctgatgcatttactggtttaattaacgaactggaaagcgccgggcaaacggtagtgctggtagtacgtaacgatgacgtgcttggtgtcattgcgttacaggataccctgcgcgccgatgctgcaactgccatcagtgaactgaacgcgctgggcgtcaaaggggtgatcctcaccggcgataatccacgcgcagcggcggcaattgccggggagctggggctggagtttaaagcgggcctgttgccggaagataaagtcaaagcggtgaccgagctgaatcaacatgcgccgctggcgatggtcggtgacggtattaacgacgcgccagcgatgaaagctgccgccatcgggattgcaatgggtagcggcacagacgtggcgctggaaaccgccgacgcagcattaacccataaccacctgcgcggcctggtgcaaatgattgaactggcacgcgccactcacgccaatatccgccagaacatcactattgcgctggggctgaaagggatcttcctcgtcaccacgctgttagggatgaccgggttgtggctggcagtgctggcagatacgggggcgacggtgctggtgacagcgaatgcgttaagattgttgcgcaggagataaggcaaaccgatcgcaacattgagcgcgatcggtcccctcgcccctctggggagagggttagggtgaggggaaaaggcggcatcgaagccaatcagcccctatcaaccgcctttacgaatcaaataacgataaggcagtccatccgtctctttagcaaccagttcgtgttccataaaggtacaaaacccaggaatatcgcgggtagtggccggatcgtcggcgataatcagcaacgtttcgccaggctgcatattgcgcacggttttgcgcaccatcatcaccggttccgggcagcgcaggccaagcgcgtcgagtgtgtggtcagggctggaaaagagatcggtcattttcttctcatcacttaaaaaaacggcgctagtttacgccctgtgagtccgtaagcaaactaggttaacgattgcgtgaaaattaaccattgcattgtcaacgtaaagcagtatcatgcggcggctcgaaaaaagggtaagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaagttttaagatgatgaggcggcctcagggacgtgttccggaggccgtttttttaatcgccacgtcagtaataacgcgattgcgaccagtcccgccgccgccagataaatcaccggtacgcccgcccagctcatcaccagcccagccagtggtccagtcacgccaagcgataaatccataaatacggtgtaagttgccagcgccgccccctgattttgctgcggaaccgcttttaccgccactacacccaatgccgggaacaccagcgaaaacccggcccccgccagtaagacgccgattttcgccatccacggcatagtcgccacgccaaccagtagcaggccgattatctcaacgctaaagcaaatcatcgctacgtttaagccaccgatacggttaatgccgttagggaataacaaacgcgtaccgacaaacgcacagctaaacagcgtcagcgcgaaagccgcaccgtcccaacctttagcgtcataaaacagcgtgataaaggtggcgatgacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacgcctaacggcgcacccatcgccatcgccccgtaagtgacaatgccgttccacgaaatcacccgcccgatatgcagcgagccaaccacgccaacgccccatagggtcgatcccgttccggcaaaactttgcccaatcccaaggatgacgcgccccaggcaaagtaataacaggctgatgacaggcagactggcggttaatcctgccgtcagataccccagaccgctcaaaaagcagccgcataaaccgaagacgacaatctttttgggtcccagcgaatcggcgtaacgtccggcatgagggcggctcagcaaggtggcgaaatattgcaggctgataaccaatcctgcccagaaggcgctaaagcccatcacatcatggacatagcccggtaatacagcgagcggcaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcggggagtacaacgccccgttgccattacgattgtagtggtggtgatgctgatcgcactaaccgcgctggtcggcgtactggcggcatcgtttaacgaatttatctctatgctgccgaagtttaataaggagctgacgcgcaaactttttaaattgcaggagatgttgccttttcttaatttgcatatgtcgccggagcgaatgctgcagcggatggactcggaaaaagtggttaccttcaccacagcgctaatgaccgggctttccggggcaatggcgagcgtgcttttgctggtgatgaccgtagtttttatgctgtttgaagtgcgccacgtcccttacaaaatgcgttttgcgctgaataatccacagattcacatcgcgggattacaccgcgcacttaaaggcgtttcgcactatcttgcattgaagacgctactcagtttatggacaggtgtcatcgtctggctggggctggagctgatgggggtgcagtttgcgctgatgtgggcagtactggcgtttttgctcaactacgtgcccaatatcggcgcggtaatttccgccgtaccgccaatgattcaggtgctgctgtttaatggtgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggtagcaaactggcgattttactggggccgggcagaccgaaaagtcggttaccgggatgaggcgacaagtgatacgatacgcactttcattttccattaaacgttggccctgatatgtatcggatagttctggggaaagtttcgaccttaagcgcagctccactgccaccgggtttacgcgagcaagcaccgcaaggtccacgacgcgaacgctggctggcggggcgtgcattgctttcgcacacgctttccccgctaccggagatcatctatggcgaacaaggcaaacctgcatttgcgccggaaatgccgctatggttcaacttaagccatagcggtgacgatatcgccctgctgttgagtgatgaaggcgaagtcggctgcgatatcgaagtgattcgcccgcgcgccaactggcgctggctggcgaacgccgtattcagcctcggggaacacgctgagatggacgccgtgcatcctgatcagcaactggaaatgttctggcgcatctggacgcgcaaagaagccatcgttaaacagcgtggcggcagcgcctggcaaatcgtcagcgtagacagcacctatcactcctcgctgtcagtcagccattgtcagcttgaaaatttaagccttgcgatctgcacccctactccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgctctccacactccgccgcactctatttgcgctgctggcttgtgcgtcttttatcgtccatgccgctgcaccagatgaaatcaccaccgcctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattcagaagatggtaaaacctggaccttcaccctgcgtgatgacgtgaaattctccaacggtgaaccgttcgatgccgaggcggcggcagaaaacttccgcgcagtgctcgataaccgtcaacgtcacgcctggctggagctggcaaaccagattgttgatgttaaagcactcagtaaaacagagctgcaaattaccctgaaaagcgcctactatcctttcctgcaagaactggccctgccccgtcctttccgttttatcgctccctcgcagtttaaaaaccatgaaaccatgaacggaattaaagcgccgattggcaccggaccgtggattttgcaggaatcgaaactgaatcagtacgatgtcttcgtccgtaacgaaaactactggggcgaaaagccagcgattaaaaagatcacctttaacgtcatcccggacccgactacccgcgcggtggcgtttgaaactggcgatatcgacctgctgtacggaaacgaagggttattaccgctcgataccttcgcccgctttagccagaatccggcttaccacacccaactgtcacagccgatcgaaaccgtgatgctggcgctcaataccgccaaagcccccaccaacgagctggcagtacgtgaagctcttaattacgcggtaaacaaaaaatcgctgattgataacgcgttgtatggcacccagcaggtcgccgacaccctgtttgccccttctgtgccctacgccaacctcggcctgaaaccgagccagtacgatccgcaaaaagcgaaagcgttgctggaaaaagccggttggacgctgcctgcgggcaaagacatccgcgagaaaaatggtcagccgctgcgcattgaactttcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatatgatccacacgccttcctcagttcaatgcgcgtaccgtcacacgctgacttccaggcacagcaaggattagccgacaaaccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttctgatgctgcgcctcggtaccggcgacccggcgctcgattatttgcgtctgtctaacctgccgccgacgccggagatgctggcctctacccgcaccatgctgggactggatcagccgctgtacgtccagtacggcacctggttgtggaaggcgctgcatcttgactttggtatctcattcgccagccaacgcccggtactggacgatatgctgaacttcctgcccgccacgctggaacttgcaggtgcggcgctggtattaattctgctcacttccgtaccgctcggtatctgggcggcgcgccatcgcgaccgtctgccggatttcgccgtacgtttcatcgcgtttcttggcgtgtcgatgcctaacttctggctggcgtttttactggtgatggcgttttcggtgtatctgcaatggctacccgcgatgggttacggcggctggcagcacatcattttgcctgcggtttccattgcctttatgtcgctggcgattaacgcgcgtttactgcgcgccagtatgctggacgtcgccggtcagcgtcacgtcacctgggcgcgtctgcgcggcctgaacgacaaacagaccgaacgtcgccacatcctgcgcaatgcctcgctgccgatgatcaccgccgtggggatgcatatcggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcgcacgcgtgaactttttcctctcttcccgctggtcggtacgcctggcgctgatcattatcgccctgctggcgctgattgcgctcaccagccagtggtggctgccgtatgacccacaggcgattgatttgccgtcgcgcctgctttcgccggatgcgcagcactggctgggcaccgatcacttaggtcgcgatattttctcgcggctgatggcagcgacccgcgtgtcgctcggttcggtaatggcctgcctgctgctggtgctgacattagggctggttattggcggcagcgccgggttgattggcgggcgcgttgatcaggccaccatgcgcgtcgccgatatgtttatgaccttcccgacctcgattctgtcgttctttatggttggcgtgctcggcaccgggctgaccaacgtaattatcgccatcgccctgtcgcactgggcgtggtatgcacgcatggtgcgcagcctggtgatttcactacgccaacgcgagtttgtgctggcgtcacggctttccggtgcgggccatgtgcgggtgtttgtcgatcatctggcaggcgcggtgatcccttcgctgctggtgctggcaacgctggatatcggccatatgatgctgcacgtcgcggggatgtctttccttggcctcggtgtgaccgcgccgaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcagccgctggtacacggtgtatcgttaaccctgcaacgcgggcgcgtgctggcgttagtcggcggtagcggcagcgggaaatcattaacctgcgccgcaacgctgggcattttgcccgctggcgttcgccagacggcgggggaaattttagccgatggcaaaccggtttcgccttgcgccctgcgcggcatcaaaattgccaccatcatgcagaacccgcgcagcgcctttaatccactgcacaccatgcacacccacgcgcgggaaacctgcctggcgttagggaaacccgccgatgacgctacgcttaccgctgccatagaagcggtggggctggaaaacgccgcgcgcgtgctgaagctgtacccgttcgagatgagcggcggcatgttgcagcgcatgatgattgcgatggcggtgctgtgtgaatcaccgtttatcatcgccgatgaaccgaccaccgaccttgacgtggtagcacaggcgcgcatcctcgatctgctggaaagcattatgcaaaaacaagcgccgggaatgctgctggtgacccatgatatgggcgttgtggcgcgtctggcggatgacgtggcggtgatgtctgacggtaagattgtcgaacagggcgatgtagaaacgctgtttaacgcccccaaacatacagtgacgcgcagcctggtttccgctcatctcgccctctacggtatggagctggcatcatgactttacttaacatctccggcctttcccatcactatgcgcacggtggatttaacggaaaacatcaacatcaggcggtgctgaataacgtttccctgaccctgaaaagcggcgaaaccgtcgccctgctggggcgcagcggctgcgggaaaagtaccctcgcgcggttgctggtgggtttagaatcgcccgcgcaggggaatattagctggcgtggcgaaccgctggcgaaactcaatcgcgcccagcgtaaagcgttccgccgcgatattcagatggtatttcaggactccatcagcgccgtgaatccgcgcaaaaccgtgcgcgagatcctgcgtgaaccgatgcgccacctgctatcactgaaaaaatccgaacaactggcgcgcgccagcgaaatgctgaaggcggtcgatctcgatgacagcgttctcgacaaacgcccaccgcagttaagcggcggccagctccagcgcgtctgcctggctcgcgcgctggcggtcgaaccgaaactactgattctggatgaagccgtttctaaccttgatctcgtgttacaggcgggtgtcattcgcctgctgaaaaagctacaacaacagtttggcaccgcctgcctgttcatcacccacgacttacgcctggtagaacgcttttgccagcgggtaatggttatggacaacggacaaatcgtcgaaacccaggtggtgggagagaaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagcctgagccagcgtcgtggttataacaaccgttccgaagctatccgcgacattctgcgtagcgccctggcgcaagaggccacccagcagcacggcacgcaaggtttcgcggtgctgtcgtatgtgtatgaacacgaaaaacgcgacttagccagccgcattgtctccacccagcatcatcaccacgacctctccgtcgccacgctgcatgtgcacatcaaccacgacgactgtctggaaatcgccgtgttgaaaggtgacatgggtgacgtgcagcattttgccgatgacgttatcgcccagcgcggcgtgcggcacgggcatttgcagtgcttgccgaaggaagattgagtctattattgggtcctttggtgaacgatcaacaaagggccactagcacacctgattcctctctaaataccctatccgaaccttctcttttgtaacgttctaaatatattcctaaaaatcttcaattcattgtgaccacaagtttttcttcgctttttcgtatgaagatactgtcattaaaataatagaaaaggattttacgatgagcggaaaaccggcggcgcgtcagggtgacatgacgcagtatggcggtagcattgttcagggttcagccggggtacgtattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctgacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacgatacagaacgacaggagccgcatccagacgatttatcagccggggagcttcacgccactcatcagggtcgaaactgccaccggtgagctggcgaaaacgcagcgccgcagcctggcggatgcccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgaatgaagagaacccgcatcagctgcagcagcttatccggctgccggggcagcagtatgatgaggagtccggcctgtattacaaccgccaccgctattatgacccgctgcaggggcgatatatcactcaggatccgattggactgaaggggggatggaacctgtatggatatcaattgaatccgatatcagacatcgaccccctgggtttatctatgtgggaggatgcaaaatcgggggcatgtactaatggtctttgcggcacactatccgctatgataggtccagataaatttgattctatagatagcaccgcatatgacgccttaaataaaataaatagccaatctatttgcgaagataaagagttcgctggtttaatatgtaaggataatagtggcagatatttctcaacagcacctaaccgaggagaaagaaaaggatcatatccattcaatagcccttgccctaatggtactgagaaagtatcagcttatcatactcatggtgcagatagtcatggagaatattgggacgaaatattttcaggtaaagatgagaaaatagttaaaagtaaagataacaatatcaagtcattttatttaggtacgcccagtggtaattttaaagcaatagataaccacgggaaggaaataacaaacagaaaaggattacctaatgtctgcagagttcatggtaatatgtaaaaaaatattgtttaggaactgtgtcattgtatctttgtttgtttttacatacaacacatgggcgcagtgtaataataatattaaaataatgcgcaagtatgaaagtgaaggtaaatataccgttagaaatttggttaaaaataaagctatagcattggaattagctgagatatatgttaagaatcgttatggacaggatgccgcagaagaagaaaaaccatacgaaatcactgagttaacaacaagttgggttgttgaaggtaccattcactcagaccaaattgctggtggggtttttattatagaaataggcaaaaatgatgggagaattctgaattttggccacggaaaataagtatgtaaggataatcaaacatcgtgtgcgctgatggcagagtaggtggaggactccagacagtcaaacgatagaaaaagatagcctttatggaggttcctgcaatgtcaaatacataccagaaaagaaaggcaagtaaagagtatggtttatataataaatgtaagaaactaaatgatgatgaattatttcgcttacttgatgatcgcaattccttgaaaaggatttcatctgccagagtattacagttaagaggggggcaagacgctgttagattggcaattgaattctgcactgacaaaaattatatccgtagagatatcggagcatttatactcgggcaaatataaatttgcaaaaaatgcgaagataatgtttttaatattttgaacaatatggcattgaatgataagagtgcttgcgttcgagctacggcaatcgagtcaacggccagggaaagatcatcaaaagttcactttttgcactaaataattcgcattttatgtttaaaaattgagatattccttattacctgaagctgttttttattgcttatacatgatcaaatactccttacctaattaaggagaacaaaatggaacttaaaaaattgatggaacatatttctattatccccgattacagacaaacctggaaagtggaacataaattatcggatattctactgttgactatttgtgccgttatttctggtgcagaaggttgggaagatatagaggattttggggaaacacatctcgattttttgaagcaatatggtgattttgaaaatggtattcctgttcacgataccattgccagagttgtatcctgtatcagtcctgcaaaatttcacgagtgctttattaactggatgcgtgactgccattcttcagatgataaagacgtcattgcaattgatggaaaaacgctccggcactcttatgacaagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaacccaggggcggctaaataaagcctttgaggaaaaatttccgctgaaagaattaaataatccagagcatgacagttacgcaatcagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagccagaaatgacggtcagatattatatcagttctgctgatttaaccgctgagaaattcgccacagcgatccgaaatcactggcacgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactatctggcgtcagtccttgcggggagcgggctttcgtaatcttgccctgaatacaggactgagtatcaaaaagccggttaactgaaactgtccaggttttgggggtcagttcataaacgccttatccggcctaaaaacaactaaaattcaataaattgcaccgatgcgtagtccctataagcttacgcatcgggcaattgtatttacgccattgtcccaatcgtcttcctgaatcgcagcagcgcaatggtgaaaaatgcgccgccaattgccatcagcgtcagaaactgcggccagacgatttcgaatccggcaccccggtagaggatggcctgcgcgaggctaacaaagtgtgtcgtcggcatggtcagcataatgtcctgcaccatctgcggcatactttcgcgcggcgtggaaccaccggaaagcatttgcagcggcagcagcaccagaatcaccagcagccccagttgcggcattgaacgcgctatcgtccccataaaaatgccgattgacgtggtggcaaacagactgagcgccacgcccagcataaacagcgggatcgagccttcaatcggtacgcccagtacacctttcaccatcagcaccagcgataatcccgataccaccagcaccaccagccccatcgaccagatcttcgccatcatgatctcaaacggcgttatcggcatcaccagtaagtgttccaccgtgccgtgttcacgctcgcggatcagcgccgatccggtcaatacaatcgccagcatggtaatgttgttgatgatcgccatcaccccgccaaaccacgcgggatcgaggttcgggttaaagcgcatccgggtttccagcgataccaacggttcgctgttatcacggtagcgcgcgacaaagctgttcacttcaccgttgataatattctggatatacccattgccggtaaatgcctggctcatgcgcgtggcatcgacgttcacctgaatatccggctggcgtccggcgaggacatcacgctgaaaattaggcggaatatttatcgcgaaggtatagcgtccggcgtccagtccggcatccatctcatcggcggtgatcatctccggtggcaaaaaccacggacgatagaagctgttaacgatccggttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattgcgtaaatggcgcatcatccctcctgttttttcagcagcaggatacttaagcccatcaccagcgggatggctatcagtaacgggataaaaagttgccacaaatcagtcagatccagcgctttcgagaacgtcccgcgggcgatagtcagaaaatgactggtcgggtaaacctcgccgatccaacgtccaggcccttccagcgaagctaccggatcgatcatcccggaaaactgtgtcgccgggatcaacgtgataatcgccgttccgaaaatggcggcaatctggcttttcataaaggtggagatcagcagccccattccggtggcaatgatgatatacagcagcgccgccagggtgagcgtcaggaaactgcctttatgcggtacgccaaacacaaacaccgacaggccgcagagcaggaaaaagttcagcatccccagcgcgatgtatggcaactgtttaccaagcaaaaattcactacgcgtggtgggggtcacgtaaaggttgataatcgacccaagctctttttcccgcaccacgctaagggcgcttagcattgacgggatcatcatcagcagaagcgggatcaccgccggaacaatcgctggcaggctttttacgtccgggttatagcgatagcgcgtctcaatattcatcagcccgctttggctggcgggtgtcgattgtcggctcgccacatcctgtaaccagctctggtgcatggcctgcacgtaaccttttaccgtttcagcacggctcggcatcgctccgtcgatccagacgccgagttccacaggcgtaccacgcgcgatatcgcgcccgaaattgggcgggatctcaatcgccaccgtgatatcgcccgcacgcatccgacgatcaagctcgtcataactggtgagcggcggctgttcgataaagtaacgggaaccggagaggttgagtgtccacgcctggctactgacggtctggtcgcggtcgagcaccgcaaagcgcaggttttccacatccatactgatgccgtaacccattatcagcatcaggatcaccgttcccatcagcgccagcgtcgaacgtactggatcgcgtcgcagttccagcgcttcgcggcggctgtagctaaacagacggcgcaggctaaatccctgacgcggcgcgtgggtggtgtcgtgtaccacgggcggcgcttcggcttcgttgctctgccctgccgcttcctgcaaataggcgataaatgcctcttccagactggcggctccgcgtttctcaaccagttcctgcggtgtaccgctggcaagcacttttccggcgtgcatcagtgagatgcggtcgcaacgttccgcttcgttcataaagtgggtggagatgaagatagtcactttgtcctggcgcgagagatcgaccatcaactgccagaacatatccctcgccaccggatcgacaccagaagtaggctcatcgaggattaacatctccgggcgatgaatcaccgccaccgccagcgaaagccgctggcgaatgccgagcggcaatgactccggcagaatatcttcaacgtcgttgagcttaaaacgctcgctcatttcagccactcttgcgggaatttccgcttccgggatgtgaaacaaacgggcatgtaactcaaggttttgccgcacggtgagttcgttatagagcgaaaacgcctgcgacatatagcccacccgacggcgggtatcgatatcttttggatcaaccggttgcccgaacagccacgcctcaccttcgctggcgggcagcagtccggtgagcattttcatggtggtggatttaccgcagccgttcgaaccaagaaaaccaaaaatctccccgcgtggaatgcggaaattaacgtgatcaacggcaacgaaggaaccaaaacgcatggtcagatcgcgcgcttcgatggcaatctctgcgttttcaggttgatacggtgggatcactaccgcctgatgcgcctggcgttgcgcttgcggtaacagatttataaatgcttcttccagcgtagcgctttgcgtttgctgccgtagctcttcggcgctgccagttgccagcacttctccggcattcatcgctaccagccagtcgaagcgttcggcctcttccatataggcggtggcgaccagcacgctcatattgctctgccgctggcgaatactgtcgatcagatcccagaactgggagcgggagagcgggtcaacccccgttgttggctcatcaaggatcaacagttccgggtcgtggattaacgcgcagcacagcccaagtttttgcttcatcccgccggagagtttccctgccggacgatcgcgaaacggtgctaacccggtgctggtcagcagctcattgattcgcacttcccgctccgctttgtcgtgaccgaacaggcgagcgaaaaaatcgacgttttcatacaccgacaaggtgtggtagaggtttttgcccagcccctgcggcatccaggcgatgcgcgggcagacgtcgcggcgatgcttcgggtcgcgcatatcgccgcccagcaccatcacattgccctgttcaatgacgcgggcaccggaaatcaacgacaacaagctcgacttcccgacgccgtccgggccaatcagcccgaccatacagcgggccggaatatcgagagtgatattgttcagcgcaacggtttttccataatgctggctcacgcccgccagttgcgcgacaggcgggacgggaaccagttccagatgcgtcattgcggcaacctcaccacgaggtcgtcaggccacggaagttcttcattcacccgcacccacgctacgcccggcaaaccggttttgacatattccagatgctgctggagtaattccggtgggatacgcgctttgacgcggaacatcagtttcagccgttcatcgctggtttcgacggtttttggcgtgaactgggcgacactggcgacaaaactgatggttgcaggaatacgcagatctggcgcggcatcgaggatcagccgggcttcaccgcccagtttcagcgtgcccgcctgttcggttggcaggaagaaagtcatatagacgtcgctgagatcgaccatattcagcacccgaccgcctgccgccagcacttcgcctggctcggcaacccgatactgcacgcgtccgtcacgcggggctttcagttcgctgtcatcgatatctgcggcaatgcgccgttcagtggcttgtgccgcttcgacgcgggtttgcgcctgaatgatattggtgcgtgccgcttctatagccgctttagaagccgatacctgagctttcgccgattccagcgcagctcgggcgctctcagcggcggcgcgatcgtcatccagctgttgcgcagaaatagcccctcgttgggccagtgaacgggaacgcgtatgacgttttgctacggagtccagttctgcctggcgttgattaaccagcgactgtgcggcacgagtttcgctttgtcgttgctccagcaaagcctgcgcggcagcaacggcgctttgtgcctctttgatttgcgcgatggcttccagtcgctgttcctgcaacacgcgagtatccatcttcgccagcacttcaccttcgcgaacaaacttgccttctttcaccagaatggtgtcgatacgcccggcaattttgctggcaatatccacttccgtcgcttcaatgcgcccattactgacagcaaagccttccggcacacctgccgggcgcaacagccaccacgccacgatagccgccaccgccagtaacccgacaacccaccacgccagatggcgcttactcttatccataatcgacccgccataatccctgtaagcaaacgacgcgtgttacaactgccgccgaacgacgttcagcggattcttccatccgggataagaaggaaacggcaaatacgaccagcgcgcagagcattgagcgccaacggggaaggcttagtgaaaacgggtagtaatgttgtcatcatcagcattcctggccgtaaatgaaacacgcatactcataagtgtgatctataaaactggctgacaaaacggtatccatcctgttggatagcgtttcacgcctgttcagttgcaggaacagagcattcctttttacgttttatcaacagtctcaaccagatagtaacattaatattcatgttgtctatggttcagagctgtaacattgtgcgccttctaatcaaaggcataagtccatttctgtttttttcatgctggtaagacttccagggagtggttatctcaggccctgcaccagggttaatttggcaattatgcatgctgaacattcttccagcatgtttactgtcacgggcgttaagacctaaaactgtccccgtttcgcctatgcgttctcttccaccatttccgttatgtgcaacaacttgatttatacctaacatttgtgaacatgctaatagtgcttcaagtttaggtctgtaatctgtcgaaacagaaaaataacgattaaaggatcgacaagagatagcccggctagttttaaactttttgccattaattatagcatgatgctttttattgataattgccgctaattcgaccggatcgagagcattggtcatttcatcaatagagactgttatcggtcctataatgtaacgttttcgctgatcatcaaaagttatcccatgatgatttgccattattttgtatttggggtcatagaaacatacaggataatcttttatcccagagtaggtatcctcatcgagtggtttcatacgcgtgaagttctgcatatagttaccattgcaattcgtttcatgatttccagctaatacatgaacattttcattgatactcattatgcgttttaacaaatcgatgataaattgatcaccacagatattgctaaatcgatcgccggtttggtcgcccagaaacgtacatggcgtcacagcgtctttattaataactaaataaggctgaagactttctaaaataatgtctcttctgttcaggatactgattattgtattaacattagtgttaagttgctcattaaagttctcccttagcaatacgttgagaacttcatcttctatattaagcaactggctaaggaaattttctccttcagccatgattcccaaatgtcccgttgcgaaaagcgcgaacaaaactgcaccgactgagccatcggtatcaccaaaataggttggtctggtacttgtgggatcaacgggtaaacaattggagaaatagattctgtcagcgaactggggttttatcattgtttcgaatttaatatcagatacattatattgcgatattttccagttccagatgggtttgtacgactcagtaactgcaacatcattagcattatcatttactgtcatattattaagtaaataaacaatactgcaccaattaatatcggtattatcaagagagcaaccgtaatttttgctattaattgtcacaataaactgataattattattcctacgtagaatatgagcacgcatgcccgatagcatactatatttttctgaatgatccgtttgtatggtaaatgaaattttgtcatcttgaatagattgttggaaccgttctatttgccaatcatctattttttccacaacctcaccgagcattgtcctggcaatacttgatatatcatcacctataccatttgcaatatacccaaacagttctttagtgaagttggtaacatgctcttgcaccatatcatttgttgcgattgtcgttgtactgtcgttagtgcctgccacagttccaattttcatattttacctcatattatttaccgcgaggaatacatagttaacattttatcttatgacatacacctcatgttcgatgggaaaataattatattttgcacaaatcattcagcctcaaagcataatatgaaatttcttatctcatagcagagaaagtccctaaagattgtagaggcgtcatcagaacatgcctctacaatcgattaagaaaacctatgaaatactggcaggattaaaaagacataccaccgtattcatggagttttaatgtagttgaaaacaactaagccctgaggaataaattattttattatttttatcacgtgcttccttcagggaatttagccccataataccattatcaaattgttgattatgatctaccccgggcccatgatgcccatatttttgtctaatgtatttgctggggtcttcacctttgagtgtctccccacatatgaagatacgttcacgtgctggtctgaaatcagtagtgttatcaaaataattagcatatacaggtgtgggtttcaaagtattgcttcggattagatggaatagaggatcatccatgtgttctttatgttttttattaaaaatattggctaattcctcaggatcagtaggatttttcatctgattaaatggaacctgcaaagcaccgagacaataacatttttttcttcatctcttattattccgtgatgactggttaaaacttgcctttctgagtcataattacaaacatcgagcgttttaattaagttatacgtatcaccggcagagagtttatgatttgctagtcgtgcagtatagttaccattaaaattgatttcatgatttccagccagaacgacgacatttttattaatacggctatctttattaccctccatatttcgcatagaatttagcaaagtaaggatatatttatcaccaaaaatagtactaaatctatcgcctgtatgatccccaaggaagatacaaggggttatcgcatcgtcctttaaaaaaacatgttgatgcaactcattcaagatcatgtctctcgtatttaataaatcgtagagcactttattatttttatgtttgtatgcagatgaagccatctcttcgtgttttaataattcacataataaactccaacccttttccctgatgcctatatgccctgaaacgagcaatgcataaagtacagcgcctactcttccatctgtatcgccaaaataagccgtgttggcattttgtgggttaatcacaccacactgtttatagaagtctatttttgaaaacacagatttaacatagctatcaaacttttccttagtaaacgtctctttagagacatcccaacgccagtcaggtttgaaattaccactaagaagagtaaagaaatttctcgctatgatagaaagcccatcaactttataaattatatctgatttatctccagaggaattaataaaataataaccgcccttacactcaacagtaacggtaatgggagacgataattttaacacatggttattgtctggtataattgtaaagataaacgtatcagtagtattgtcggcgaatctattatattcttgaatatctatagaaggttcactattataaaaccatactttctccatctggtgactacgatcatttaccttccagtgaccatgttgcaggaaatagatgatatgcaggccaaaatcgttatctatttgcgaatcattatccagtttatcaaattcaactatctttgcacgatgtgttttatcaaccttgccatggtgttgatgactgttaactttatctgaatgcttatcttgatggcttgaagagatgtttctaatctgattgtcaattgctttcataaataacctgtgatatttttgaattgtttgtaacaaaataaatgatacttgtctgaaaaacagatttacgacgatataaaataataatacttatatgttcgctgattttaagcaccgagactatccggtcttttaccaaataatgaagaataatccctccctggaagataattgtaaaaaacaacagcataagaattaatcttaggataaatttttatttatcatggccttttgaacgctgaaaagtagcgctctgcaaagtaaaccccgctatagttatgctatgcatttgtctttaatgatatctcgtcattatattaacaggatgaaattatcattaatgcatatttcaatattagcagggatacctgaggagtttaaagtgaacatatatatcgggtggcttttcaaattaatccctttgattatgggcttaatttgtatcgcgttaggtggctttgtgctggaaagttcagggcaaagcgagtatttcgtcgcgggtcatgtgctgatttctctggcggccatatgcctggcattattcactaccgcatttattatcatttcgcagctcacgcgcggcgttaatacgttttacaatacattgttccccattattggctatgcggggtcaattatcaccatgatatggggttgggcactgttagcaggcaatgatgtgatggcagacgagtttgtcgccggccatgttattttcggcgttggtatgattgccgcctgtgtatcgacggtggcagcgtcatccggtcactttctgctcattcccaaaaatgcagcggggagcaagagcgacggaacaccggtacaggcttattcttcattaatcggtaactgcctcattgccgttcccgttttactcaccctgctcggtttcatttggtctattacgctgttacgtagtgctgacataactccgcattatgtcgcgggtcacgtattgcttgggttaaccgcaatctgtgcctgtctaattggccttgttgccacaattgtccatcaaacacgtaatacgttttcaactaaagaacactggctgtggtgttattgggttatttttctcggctcaatcacggtactgcaggggatatacgtcttagtcagttccgatgcaagcgcccgactggctcccggcattattcttatttgcctcggaatgatctgttacagcatattctcaaaagtctggctactggcactggtatggagacgtacctgttcgttagccaacagaataccgatgattcccgtcttcacctgcctgttttgccttttcctggcatcgtttcttgcggaaatggcgcagaccgacatgggatattttattccttcgcgagttctggtcggtttgggagcggtatgctttacgttgttctcaatcgtttcaatattagaagcgggttctgctaaaaaataattgcaacgtaccggataaaaccagcgttgaccatttgcgtaacgctggtttttcttaggcatcatgaaataacgcagcattaatgcatagtggttaagtataaaaaacagcaaagttactgtttttttcaacctgttcatatttcataaagatctggccactgagtgagttttcaatcacctttccatccaccttatattaagcatggagggtttcagttcacgggctcattagaaaataatcacaagataaccactatcaaaattagctcatttttaatgcgactctaataattttcatctttaggaaataggtcaggacgactttgctgcaatcaaatcctgcgcacaagcccacgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcggtcaatgtgctaatcagtgcctgttggtcacgcacgttgagctgttttagcgaaacatccgggatttgcccgagttgctgtaagcgttcaaccaaccgcttcggtagatgaaccgccagtgtgtttttcaggctttgattcggatgtgcgttacgctgctcattcaggaaggtttcgaggtccacatccggtagcagattgatgctgacaaattcccccggttgccagtagcttgaaatctgcaacaccgccggtccagacaagccgcggtgggtgaagagtaagttctcacggaaaacggtgccgttttcagcggtaatcacggaaggcaccgccacgcccgccagcacctgtaactcttcgagcaacggtttatgcagagtgaatggcaccagacccgcgcgggtcggcagcacgttgaggccaaattgttcggcaatcttataaccaaacggcgacgcgcccagccccggcattgacagcccaccagtcgcgatgaccagcttttcgcaaccgacagtcatgccgttcagatcaagcgtgaagcctgtttcatccttcgccacactcagcacttcgctacgcaatctgaaggtcacattgcccttctcgcactcatccaccagcatgtcgacaatctgctgcgcggagtcatcgcagaagagttgccctaacgttttctcgtgccaggcgatgccgtgtttattgaccagatcaatgaaatcccactgggtaaaacgtgcgagtgcagacttacaaaaatgcggattctggctcagataagcgcctggttcgacataaaggttggtaaagttgcagcgcccaccgccagacataaggattttgcgccctggttttttaccattatcgatcagcagaacccggcgtcctgcctgacctgccagcgcagaacagaacatacccgccgcaccagcgcctataataatggcatcaaacctttccacgttgcgctcctcttagaaaaaacgggcgtgaattgtaaagattcctcagtggtcgcaccagcatcaatattactaaaaggaagtatttgcctgaattatataagataattattttttgagtgaaatccatacagggggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggcgtcgcgccagcaggcttcgtggtgaacatgaatgccactggctacgaaatcacccgtacccgtgatgccatcaacaacgtcgaagcttactttgagcagcatcctgcgctgctcaaacaggctaccggtgctgatcagttagtaccggctccggaagctggcgcaacgcaacctgcggagttccactgccatccgtcgaataccattaacgcgctcaaccgcctgaaaggtatgttgaccaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcaccggtgtggatcatcatggcggtcgcgctggcgttaggtatcggtacgatgattggctggcgccgtgtggcaacgactatcggtgagaaaatcggtaagaaaggcatgacctacgctcaggggatgtctgcccagatgacggcggcagtgtctatcggcctggcgagttataccgggatgccggtttccactactcacgtactctcctcttctgtcgcggggacgatggtggtagatggtggcggcttacagcgtaaaaccgtgaccagcattctgatggcctgggtgtttacccttccggctgcggtactgctttccggcgggctgtactggctctccttgcagttcctgtaatcgtacgcaccaaaacgagcgggtcagctggcccgcttcagattgtgacatagtgcgctttgttcatgccggatgcggcgtgaacgccttatccggcctacaaaaacatgcaaattcaatagattgcagagattatgtaggcctgataagcgtagcgcatcaggcaattttgcgtttgtaatcagtctcgagcgggtcagtttactggcccgctttttttatgcgttattattgctgaagtgcttaatgccaaatcatcaatgcaatcaggctgaccaccaccagaccacacaatgcgctggtcagaataaactgccgacgcacccgctcacagcggcgaataaattcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatacgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttattgatgtgaatctgggtgatatgcagaaacgcatctctgaagagacacatcatgcactgaccgagctttccactaatgcaggctacccaatcactgaaaccctgagcggcagcggcgacctgggccaggttctggtcgatgcaatcaagaaatacgatatggatttggtggtttgtggtcaccaccaggacttctggagcaaactgatgtcttccgcacgtcagctgatcaacaccgttcacgttgatatgctgattgttccgctgcgcgacgaagaagaataatcttccctctacgacgtgttcctgaacgcccgcatatgcgggcgttttgctttttggcgcgccttgttacctgatcagcgtaaacaccttatctggcctacggtctgcgtacgcaatcaaaatccccagccaatacaacatttaacaccatcatattttccatcattagtgtgatcatctggttattttctgttgtaatagtgtattaatctattcaccgcatcaatattaagaatctctgacagatgtaaactttttcgcgcgttatcccttacgcgttcatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttggattctcgcaagagcaggcttttgtcacttttggtgcttttgctgcgctggtctatggcctcatttccattggcggctatgtcggcgaccacctgctggggaccaaacgcaccattgttcttggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctatccgccgaaagatccgcggcttgatggcgcattcaccctgttctatatgtcgatcaacatcggctcgttgatagcgttatcgctggcccctgtgatcgctgatagattcggttattcagtcacctacaacctgtgcggggcggggttaattatcgcattactggtttacatcgcctgtcgtggaatggtgaaagacattggttctgaacccgacttccggccaatgagcttcagcaaactgttgtacgtgttacttggcagcgtggtgatgatcttcgtatgcgcatggctgatgcacaacgtagaagtcgccaatctggtgctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacatcgctgaacttctttgccatcaacaacgtgcatcatgaaattctcggtttttccatcaacccggtcagcttccaggcgcttaacccgttctgggtggtactcgccagcccaatactggcaggcatttacacgcatctgggtaacaaaggcaaagacctctcgatgccgatgaaatttactctcggcatgtttatgtgctcactgggctttttgacggcggcagctgcgggaatgtggtttgcggatgcacaagggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcggtgccggacaacattaccgatccgcttgagacgttgcccgtctataccaacgtgtttggtaagattggtctggtcacgctgggcgttgcagtagtgatgctgttgatggtgccgtggctgaaacgcatgattgcgacgccggaaagccattaattattcttgcagaaagcagggtagcgttatcgctaccctgttttagttttacactggcgtacctgcatagatatcaaagcgatgccctttagtgactaccgcgtttggcgtggcgacattcgccagcggtggcgcgtagtccgggcgctttaccaccacgcgtttggtcgccagcaagcgtgcaggctccagtaatccatcggcatcaagatccggtcccaccagcgactgaaagacacgcatctcttttttcactagcgcgcttttctgcttatgcgggaacatcgggtcgagataaaccacctgcgggcgcggggtaatatcagtcagcgccgtcaggctggaggcgtgaattaactgcaaccgctcctgcaaccagccgccgatttccgcatccgcataaccacgcgccaggccgtcgtcgagtagcgcggcaaccactggattacgctccagcatccgcacgcggcagccgactgaagccagtacaaaggcatcgcgcccaagtcctgcagtggcatccaccacatccggcaaataatcgcctttaatgcccaccgctttcgccaccgcctcaccgcgaccaccgccgaatttgcgtcggtgcgccatcgctccgccaacaaaatcaacaaagatgccgccaagttttggctcatcacgcttgcgcaattccagatgttccggcgttaacaccagcgccatcaggttgtcttcatcgtgctccagcccccagcgggccgccagaacagataaggcaccgtctccggtgcctgtttcatcaattaagcagattttcactgaatgatcagcccttaatgccgtaatgctccagcatcgcatccagctgcggttcacgaccacggaagcgtttgaacagatccatcggctcttctgaaccgccacggctcagaatgttgtcgaggaacgactgcccggtttcacggttgaaaatgccctcttcctcaaagcgcgagaaagcatctgccgccagtacgtcagcccacaggtagctgtagtaacctgcggcataaccaccggcgaaaatatggctgaaagcgtgcgggaaacggccccaggacggagatggcaccacggcaaccagtttcttgatttctgccagagtttcgaggatttttgccccctgatccgggcggaactcggcatgaaggcggaaatcaaacaggccgaactccagctgacgcagaataaacagcgccgcctggtagttcttcgccgccagcattttatccagcaactctttcggcagcggttcgccggtttcatagtgaccagagataaacgccagcgcctccggctcccagcaccagttttccataaactgactcggcagttcgaccgcatcccacggcacaccgctgataccggaaacaccagcggtttcgatgcgggtcagcatatggtgcaggccgtgaccgaactcgtggaagagggtgatcacttcgtcgtgagtgaacagcgccggtttaccatttaccgggcggttgaagttacaagtcaaatacgcgaccggtttttgcaaagaaccatcagctttacgcatctggcctacgcagtcatccatccacgccccgccgcgcttgttttcacgggcatacagatcgaggtagaagctaccgcgcagttcgttattttcgtcatacagttcgaagaaacgtacatccggatgccagacatcaacatctttacgctctttagcggtgatgccgtaaatacgcttaaccacttcaaacaggccgttaaccgctttgttttccgggaagtacggacgcagctgttcgtcactgatgctgtagaggtgctgtttttgtttttcgctgtagtaagcgatatcccacggctgcaactcatcgacgccaaattcggctttggcaaaggcacgcaattgcgccagctctttttcgccttgtggacgcgcgcgttttgccagatcggttaagaaatccagcacctgctgcgggttttctgccattttagtggcaagggatttaaaggcgtagttttcaaagcccagcagttgcgccagttcgtgacgcagcgcgaggatctcttccatcaccttgctgttatcccatttaccggcgtttgggccttgatcggaggcgcgggtgctgtaagcgcgatacatctcttcacgcagagcctggttgtcgcagtaggtcattaccggcaagtagcttgggatatccagcgtcagcaaataaccttccagctctttcgcttcggcctgggcttttgccgcagccagcgcgctttctggcatccccgccagctccgcttcgtcggtaacgagtttggtccagcccattgtcgcatcgaggacgttgttgctgtactggttgcccagttcagaaagacgggtcgcaatttcgccgtaacgctgctgtttctctttcggcagacctatgccagagagttcaaagtcgcgcagtgcgttatcaaccgctttcttctgcgccgtgttcagcgtggcgtaatgatcgccatcgcgcaggtcgcgatacgctttatacagcccttcatgttgccctacccaggtgctgtattccgacagcagcggcagggtttgttcgtaggcttcacgcagttccgggctatttttcaccgagttcaggtggctgaccggggagaagatacgccccaacacatcgtccacttccgccagcggctggcagagattttcccaggtgtacggtgccccttgcgctactacgcgctccacgttttcgcggcagtcgttcaatgccttagtcacggctggaacgacatgttccgggagaattttagaaaacggaggcaattcaaagggagtcagtaacggattcgtcattcgcgcagtcctggttaaagaggttaaggaagcgctcaacaggcgctttacataatgtgtgtagcatggggttaagtgtagtgaatttcaatgagaaacgttacgctttcgcggcggcggcctcttttcggtatactgtcctgatacgcttttgtgcgccccgaatacgggccgatttttacttaccggaacacctttacccatgctcagttatcgccacagctttcacgctggcaaccacgccgacgtccttaaacataccgttcagagcctgatcatcgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcccgcagaactggaggcgtacatcaatgtggtaaaacacttcaaccgtagcggtcagttgcgttactaccccggttcgccgttgattgctcgcctgctactgcgtgaacaggacagcctgcaactgaccgaactgcacccgagcgattacccgttgttgcgttctgaatttcagaaagatagccgtgcgcgtgtcgaaaaagccgacggtttccagcagcttaaggccaaactgccgccggtttcccgccgtggtttaatccttatcgacccgccgtatgaaatgaaaactgactatcaagcggtggtcagcgggatagcagaaggttacaaacgtttcgccactggtatttacgcactgtggtatccggtggtgctgcgtcagcaaattaagcgcatgatccacgatctggaagcgaccggtattcgcaaaattctgcaaattgaactggcggtactgccagacagcgatcgccgtggcatgaccgcttccggcatgattgtgattaacccgccgtggaaactggaacaacagatgaataacgtgctgccgtggctgcacagcaaactggttccggcaggcaccgggcacgccaccgtaagctggatcgtgccggagtaattgcagccattgctggcacctattacgtctcgcgctacaatcgcggtaatcaacgataaggacactttgtcatgactaaacactatgattacatcgccatcggcggcggcagcggcggtatcgcctccatcaaccgcgcggctatgtacggccagaaatgtgcgctgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgaaaacgtgctcggtaaaaataacgttgatgtaatcaaaggctttgcccgcttcgttgatgccaaaacgctggaggtaaacggcgaaaccatcacggccgatcatattctgatcgccacaggcggtcgtccgagccacccggatattccgggcgtggaatacggtattgattctgatggcttcttcgcccttcctgctttgccagagcgcgtggcggttgttggcgcgggttacatcgccgttgagctggcgggcgtgattaacggcctcggcgcgaaaacgcatctgtttgtgcgtaaacatgcgccgctgcgcagcttcgacccgatgatttccgaaacgctggtcgaagtgatgaacgccgaaggcccgcagctgcacaccaacgccatcccgaaagcggtagtgaaaaataccgatggtagcctgacgctggagctggaagatggtcgcagtgaaacggtggattgcctgatttgggcgattggtcgcgagcctgccaatgacaacatcaacctggaagccgctggcgttaaaactaacgaaaaaggctatatcgtcgtcgataaatatcaaaacaccaatattgaaggtatttacgcggtgggcgataacacgggtgcagtggagctgacaccggtggcagttgcagcgggtcgccgtctctctgaacgcctgtttaataacaagccggatgagcatctggattacagcaacattccgaccgtggtcttcagccatccgccgattggtactgttggtttaacggaaccgcaggcgcgcgagcagtatggcgacgatcaggtgaaagtgtataaatcctctttcaccgcgatgtataccgccgtcaccactcaccgccagccgtgccgcatgaagctggtgtgcgttggatcggaagagaagattgtcggtattcacggcattggctttggtatggacgaaatgttgcagggcttcgcggtggcgctgaagatgggggcaaccaaaaaagacttcgacaataccgtcgccattcacccaacggcggcagaagagttcgtgacaatgcgttaaatgttaaagggctaagagtagtgtgctcttagcccttaattacgtttccgctatcagttcagaagctgaagcagaaagcggatcagttccagcagcgcaattaacgcccctagaacgatgattgctttatcaatcacccgttttctccatgcgatggagtgagaatgcatccgcttactcatccactgcctgtcacggcgcatgtctcattgttagataagaactctctcactccggccagagcatcagttaacggcaccacccgtacttctgaccaggactttgaaagcgtttatgcgcattgccagagtgaaaatgcctcagagctaactggataatcatacagtacatgcaggttataaaaccagcacgtccttgcaatagtttcagtatggtattagcattgatgcgttagatgatggctatctcactccagtcagagccaccaactcagggctggaaagtaaaaaaccgacgcaaagtcggtttttttacatccggattcggacaaggcttaatatgacgatgacccagtgaaagtatataaatcgtcactgcgatatataccgaagtgctccctccgccagctgaagaaatcgctaattcttgcaatgttagccactggctaatagtattgagctgttagataagaactctctcactccagccagagccaccaactcagggctggaaagtaaaaaaccgacgcaaagtcggtttttttacgtcctgattcagacctcctttcaaatgaatagccaactcaaaattcacacctattaccttcctctgcacttacacattcgttaagtcatatatgtttttgacttatccgcttcgaagagagacactacctgcaacaatcaggagcgcaatatgtcatttctgttacccatccaattgttcaaaattcttgctgatgaaacccgtctgggcatcgttttactgctcagcgaactgggagagttatgcgtctgcgatctctgcactgctctcgaccagtcgcagcccaagatctcccgccacctggcattgctgcgtgaaagcgggctattgctggaccgcaagcaaggtaagtgggttcattaccgcttatcaccgcatattccagcatgggcggcgaaaattattgatgaggcctggcgatgtgaacaggaaaaggttcaggcgattgtccgcaacctggctcgacaaaactgttccggggacagtaagaacatttgcagttaaaaatttagctaaacacatatgaattttcagatgtgttttatccgggaggcattatgttactggcaggcgctatctttgtcctgaccatcgtattggttatctggcagccgaaaggtttaggcatcggctggagtgcaacgctcggcgcagtactggcgttagttacgggcgtggtccatccgggtgatattccggtggtgtggaatatcgtctggaacgcgacggctgcgtttatcgccgtcattatcatcagcctgctgctggatgagtccggcttttttgaatgggcggcgctgcacgtctcacgctggggtaatggtcgtggtcgcttgctgtttacctggattgtcctgctcggtgctgccgttgccgccctgtttgccaatgatggcgcggcgcttattttgacaccgattgtcatcgccatgctgctggctttagggttcagtaaaggcactacgctggcgttcgtgatggcggccggattcattgccgataccgccagcctgccgcttattgtctccaacctggtgaatatcgtttccgctgatttctttggcctcggctttcgcgaatacgcctcggtgatggtgccggtggatatcgccgcgattgttgccacgctggtgatgttacatctctattttcgcaaagatattccgcagaactacgatatggcgctgctgaaatctcccgcagaagcgatcaaagatcctgctacgttcaaaactggctgggttgttttactgcttctgctggtgggatttttcgtcctggaaccgctcggcattccggtgagcgccattgcagctgtgggcgcgctgatattatttgtcgtcgctaaacgcggtcatgcgattaatacgggtaaagtcctgcgcggtgccccctggcagattgtcatcttctcgctcggcatgtatctggtggtttatggcctgcgcaatgccggattaacggaatatctttctggcgtactcaacgtgctggcggataacggcctgtgggccgcgacgctcggcaccggattcctcaccgccttcctctcttctattatgaacaatatgccgacggtactggttggcgcgttgtccattgatggcagcacggcatctggcgttatcaaagaagcgatggtttatgccaatgtgattggctgcgatttgggaccgaaaattaccccaattggtagcctggctacgctactctggctgcacgtactttcgcagaagaatatgactatcagctggggatattacttccgtacagggattatcatgaccctgcctgtgctgtttgtgacgctggctgcgctggcgctacgtctctctttcactttgtaatgagatactgatatgagcaacattaccatttatcacaacccggcctgcggcacgtcgcgtaatacgctggagatgatccgcaacagcggcacagaaccgactattatccattatctggaaactccgccaacgcgcgatgaactggtcaaactcattgccgatatggggatttccgtacgcgcgctgctgcgtaaaaacgtcgaaccgtatgaggagctgggccttgcggaagataaatttactgacgatcggttaatcgactttatgcttcagcacccgattctgattaatcgcccgattgtggtgacgccgctgggaactcgcctgtgccgcccttcagaagtggtgctggaaattctgccagatgcgcaaaaaggcgcattctccaaggaagatggcgagaaagtggttgatgaagcgggtaagcgcctgaaataaagcggcgatatcccccccacaggttgttagaaaagtgcgctttatttatgtcggatgcgacgctggcgcgtcttatccgacctacaaagttatgaaaattcgatgaatagtatgttatttgtaggcctgacaggcgtagcgcatcaggcgattttgctatttacacagtactccctgcgtgagattccaattatcgcgtccagcatggtgtatcagtgagctgcttagttatcagcgatacagcgcagtagtttaaagacgtactggattatgatttatcagtggtttacacaacaaattattaaataattataagataccttaacccattttattattacacatctaaaacatcacaaaaaaaatcacttcacacactatcagagaacataataactttttaaaatgagcgcattttgatagttgttaacgatttcctttacgatactatcactaccctttttttacacacaaatattaccgggtggagataaaagggaaatcaaaggtaattatatcaggaagatataacgcattacatttattgtgtgtagaagaaaatccattcctgttctaattatccaatttaaacatcttagcataaaacaaatgatgaataaggaattttatgtcaattgactttaccccaggtataataaatacatatcacggcgatatttataactgcacaacaaataccgataatgctaaaacgccagacacaccgaagtggccttgcgataattgggaagaacaacaacccattaattccacattctctggagaaggatatatctctgatcaatatgatttagcgcaacaccaacttcaacaaattaatgcgtgccacacgaacactacatatacaaatgcagactactcaaaagttgtggctcaacttgtaagtcttattactaacattgaaacgataagttcgacacaacttacgcaacagacacaatcaatacttaatcagattaataacattagatatgaaaaaaacaaaagtgctgaatgtcgaatcattgttatcgctaatcctaaacccgacaaggcaatcataactaaaattagcgtagaagagggaatacccataacattcagtgtccaaaccatgttttcagatactaattttattgctgaacaacgagctgacttaccaactaatataaaagatattcaaagcctgtatcaaaaaatgacgaagttatatattgagcacagtgaaaataaaaacaggatgaaagtctttgccggaaccaactttattgatttcaatatgacaggacagaacctgtccgggttcgttctaaccttgtcaaggttttatttcgaagatctacttaatataaatttcactgacgcaaatttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtgacactatttttttacataaagaacaccctacccccaaattatataaagatggacaatatcttgacaaacaaatcgaaggtttattttcaacattattaaccattaatgacaaccttttacgagcaaaagcggaaattgcttcgacaataattaaatttttagaggccaggataaccaatctttcatacaatgacatattaaaatatcagcaagaattccaaagacaatgttataagcaagttaaagcctttacgacactctcccgatacaataaaattcaaacatgggcagaaatgtctgaatatcaattcgaagtatttcaatacgagacgcttaacccaaaaaaaatgtcacacacgccttatttaaagaggccactgcctaatgaaaaagatataaattatggggtggaaatagaaataccatctggtaaaagaattcgcttatcaaatcattaccagaatataataccataatattgattattagcactttataatcattgaataaaaatagattttatgtacttttaaaacaatgcactatattatggggtgatggatattcatgtcacgccccaaaattaactgagttcacctaaacagaaaggatataaacatcagacaggtttacgttactatcaggcatatcacctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggtgggaaggttatcaacgttatcaatggcaaaacggatacgttgttagaaatctctgtattaccgttggatagctatgcgaagcctgatattgaagccaactatcagggccgactgctcgccagacaaagcggcttccttgatccagtgaactatcgtaatcactttgttaccatcctcggcaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggtgcgccttactacaccaatgcggtgagtcaggtaacacctgagctggtcaaataacaccaccgaaagatgcagatgctttctcagcatctgcatcatgcattacatcaaattaatacacagtaagctaactattattattataagccctgtcctgttaattacctttggcaaactgattataaagttaatgtccgcaccaggagtcggttatgtttcttataattaccagggatacgatgttcttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtcattattttctccccctttaatattaaacgctgcctggggaaagtgccggtgacctttgttccgcggactatcactatcattgattttgtcgcactcatcaatggcagttactgctctgtgcctgaagcggctgtgtcactttcgcgcaagcaacatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattgattatctggtgtgaatttcaggcttacggtgagtctggctacgctgccacacagattagctaattgaaacgcctttcacccctgccataccttttaataatcgcaacaggtcttctatcgacgttgtggcatgaagctggatatcaatggcgaccacttcatgatcttcattttcctgcaacgaaactaaatcagtttttattttttgctgcttaaaccagtcgagcattgataccgtattaccgttcactaatgtcagctgtaaatggtaatttttgttcatcaggcggaaggttaattgatggaagacttccagcaccaacaaggtcatcactgaaccataaatacccagttcgtacataccgctgccaataaccatacctatggcggcggtcacccagatatccgctgccgtcgtcagacctacaatattttggttacgaacgagaatgttacctgcaccgataaacccgacgcccgtcaccacctgagcagcaatacggctggggtcgagtccgacgtgatctaaagacagcacgtcagcaaaaccatatttcgaaacaatcataaacagggcgcttcccatgccaattaatacatgtgtgcgtaaccctgctcctttgccgcgcatttgcctttccatgccaatagcgccacaggcaattgccgcgagtataagacgtataataaattctgctgtcatataaaaatgcaaaaaggagcagcaagatggctcaacttgctactcctttttacttgcacctcattaattcggcaagtcattagatgcttgatttttgaaggtatacaaatttttctgcgggtttttcttacagtattcgatcactttaggaatttgagtgagatcggtttcatttaaagtaacggtatcgccacctttatatactgtttcttcatgcagcatccaccatgcaaccggggtcattgcttttggattcagatcaataaattcctggcaggtcatatctttagcggattcattggctgccaacgcagattgtgcgttcaccagtgacaaagccgctacagcgcccataaaaataaacgctttacggagagatgaaatattcattttgtaacccattcaatatagagattatatatgaacaggaggaatagctgcttttaaagaagatattccggcctgttcaatatgcaaggaagtacgatgtaacgcattcccggaattacatatctttcttaattttgtcccattcgcctttaactttatctttaaagttggcttgtttatcctgagtacaagcctgaacgatagctggggttacggttgcaataccctgaacatctaaaaccgcatcttctggtttatctttgttgttcagcgcttcagcaaaaccaactgcagttggctggaaggattcgtccacagccaggaaatcttcacaggtccaggagttgaccggttttttgttatcagctgctttttgcgcatccgctgcattgctcacaactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagatgcatcagatactgcaattaggaaatttttattaaatcgactgcattcttagacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagtttcccgttcgtctctggcgatattttaagcacagtagtgggtgcattattaatctgctcgggtattgcgcttattgtcgggttattcagcaaccgcagtcataatttctggccggtattatccggtttcctcgtcgcagtcgcctatttattgatcggctatttcttcatccgcgcaccggagctgggcatttttgccattgcggcatttattgccggtttgttctgtgttgcaggggttattcgcctgatgagttggtatcgtcagcgttcaatgaaaggcagctggctacagctcgttattggtgtgctggatatcgtcattgcctggatattccttggtgcaacgccgatggtgtctgtaacgctggtttccacactggtgggaattgaactgatatttagcgccgccagcctgttcagcttcgccagtttgttcgttaagcagcaataattaccccggttgtcacccggatcatagtcacttgatgtgactatgatccgattaatactctctccgctacgcagtgttgtagatcaattgcgcactatcattgaaataattacctgctagtgattatttcaacctactgaatttcatctaatttttttcactctatggcaaattagccatttcaaacattatcatggctgatattttccgtagtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgcgttatttactcaggtaatttcaatgcgttaaaagaaagctggcaatccaattgccagcttaagtcgaaacaaggagactcgatatttaaatcggattacattttaactttagtaatattcttcagagatcacaaactggttattgataacttattcttgggcagtaatccgcaaacgttaactttttgtttgctatttacaagctgataacaaccaggaatcttacttaggatcaatatatggagtgcgtgatggataaatctgaagtattgattagtgttaatagacgtattagttcacgaagggtaaagttcttataggcgtttactatattgaacaacgattcggacaaggatgtaaataatgaaaaggatgacatattcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggttatcattgatacctatcacaatcatatccttgatgaagaagcgattaaatttctggagaaattagatgccgagagaattattgttttggcaccttatcacatcagtaaactaaaagctaaagcgcctatttattttgttagccgcaaagaaagtatcaaaaatcttcttgagattacttatggtaaacacttgccccataagaattcacaattatgtttttcacataatcagttcaaaattatgcaactgattctgaaaaataaaaatgaaagcaatatcacgtcgacgctcaatatttcgcaacaaacattaaagattcagaaattcaacattatgtacaagctgaaactaagacgtatgagcgacatcgtcaccctgggtatcacatcttatttttagtcaggacataagcaactgaaattgatggctggcatgacgagggatgcagatgctgatttcattacccccggtgattactaaaggagaggctaaaacgactttattcccctggtatgtgtatccaccagtagaacccttcgttgcccgaatgctggcaggaactgttggcagaacggcaacattttttttgtcgttgacctcaccatgtcgatcactgtgcctgtatcccaccttactggctgacaaccccactatgccgctggtctgtaaatccctcatatctctcctcgcgcgcaatttaaagaaccgttatttctcaagaattttcagggactaaaatgaacagaagaagaaagctgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcacctttacaggccgagctaaactccgccaaaggctcgctggcgaaagcgctctctaccgccagcaatgcccgcatcacctttaaccgccaggcatcgttgctgaagaccaactacgttagccgtcaggattacgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaagatttcttacgcatgaaagaagaggtcgccagtgggcaaatcaaacaggttcagggcagtacgccagtacagctcaatctggaaaatggtaaacgctacagccagaccggcacgctgaaattctccgacccgacagtggatgaaaccacgggctccgtgacgttacgggcgattttccccaacccaaatggtgacttgctgcctggcatgtacgtcacggcattagtggatgaaggtagccgccagaatgtattactggtgccgcaggaaggcgtcacccacaacgcccagggtaaagcaacggcgctcattctggataaagacgatgtcgtgcagctacgcgaaattgaagccagcaaagccatcggcgaccagtgggtcgtcacctctggcttgcaggctggcgatcgggtgatcgtttccggtttgcaacgcattcgtccgggtatcaaagcacgagcaatttcctccagccaggaaaacgccagcaccgaatcgaaacaataacgttgcaggcttaaggggactttcatggctaactattttattgatcgcccggtttttgcctgggtacttgccattattatgatgcttgcaggtggtctggcgatcatgaacttaccggttgcgcagtatccgcagattgcgccaccgaccattaccgtcagcgctacctatccaggtgccgatgcgcaaacggtagaagactcggtcactcaggtgattgagcaaaatatgaatgggcttgatggcctgatgtacatgtcttcaaccagtgatgcggcgggcaatgcctctatcactctgaccttcgagactgggacatctcctgatatcgcacaggttcaagtgcaaaataaactgcaactcgctatgccttcattacctgaagcagtgcagcagcaggggattagcgtcgataagtcgagcagtaatatcctgatggtagcggcgtttatttctgataacggcagcctcaaccagtacgatatcgcggactatgtagcgtctaatatcaaagacccgctaagccgtaccgcgggcgttggtagcgtacaactctttggttccgagtatgccatgcgtatctggctggacccgcaaaaactcaataaatataacctggtaccttccgatgttatttcccagattaaggtgcaaaacaaccagatttccggtggtcaactgggtggcatgccacaggcggcagaccagcagctaaacgcctcgatcattgtgcagacgcgtctgcaaacgccggaagaatttggcaaaatcctgttgaaagttcagcaagatggttcgcaagtgctgctgcgtgatgtcgctcgcgtcgaacttggggcggaagattattccaccgtggcacgctataacggcaaacctgctgccgggatcgccatcaaactggctgccggagcaaacgccctggatacctcgcgggcagtcaaagaggaactgaaccgcttatcagcctatttcccggcaagtctgaagacggtttatccttacgacaccacgccgtttatcgaaatttctattcaggaagttttcaaaacactggttgaggctatcatcctagtcttcctggtcatgtatctgtttttgcagaatttccgtgccacaatcatcccgacgattgccgtaccggtggttattctcgggacgtttgcgatcttgtcggcggtcggtttcaccatcaacacgttgactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcggtattgccgttgttctttccgcagtgtttatgccgatggcctttatgagcggtgcaaccggggagatctaccgccagttctccatcacgctgatctcctccatgctgctttcagtatttgtggcaatgagcctgacccctgccctgtgcgccaccattctgaaagccgcgccggaaggcggtcacaaacctaacgccctgttcgcacgcttcaacacgctgtttgaaaaatcaactcaacactataccgatagcacccgctcgctgttgcgttgtaccggtcgctacatggtggtctacctgctgatttgcgccgggatggcggtgctgttcctgcgcacgccgacctctttcttaccagaagaggatcagggggtatttatgaccaccgcgcagttaccttccggtgccaccatggttaacaccacgaaagtgctgcaacaggtgacggattattatctgactaaagagaaagataatgtccagtcggtgtttaccgttggcggctttggcttcagcggtcaggggcaaaacaacggcctggcgtttatcagtctcaagccgtggtctgaacgtgtcggtgaggaaaactcggttaccgcgatcattcagcgggcaatgattgcgttaagcagtatcaataaagccgtcgtcttcccgttcaacttacccgcggtggctgaactgggtaccgcgtcaggttttgatatggaactgctggacaacggtaacctggggcacgaaaaactaacccaggcgcgaaacgagctgttatcactggcagcgcaatcaccgaatcaggtcaccggggtacgcccgaacggcctggaagatacgccgatgttcaaagtgaacgtcaacgctgcgaaagctgaagcgatgggcgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctactcgtctaccgaatggacctatggttcaccgcgactggaacgctacaacggcatcccgtcaatggagattttaggtgaagcggcggccgggaaaagtaccggtgacgccatgaaatttatggcagacctggtcgctaaacttccggcaggcgtcggctactcatggaccggactatcgtatcaggaagcgttatcctcaaatcaggctcctgcgctgtatgcgatttcactggtcgtggtgttcctcgccctcgccgcactctatgagagctggtcaattccgttctcggtgatgttggttgttccgttaggcgtcgttggcgcattactggccaccgatctgcgcggcttaagtaatgacgtctacttccaggttggtttgctgaccaccatcgggctttccgccaaaaacgccatcctgattgtcgaatttgccgttgagatgatgcagaaagaagggaaaacgccgatagaggcaatcatcgaagcggcgcggatgcgtttacgcccaatcctgatgacctctctggcctttattctcggcgtgctgccgctggttatcagtcatggtgccggttctggcgcgcaaaacgcggtaggtaccggcgtgatgggcgggatgtttgccgcaacagtgctggcaatttacttcgttccggtctttttcgttgtagtggaacatctctttgcccgctttaaaaaagcgtaacgtgtaaatgagagtaaggttgaacatgaaggttcagccttactctttcctgctaaccattcaccactcaacaaccagctaaccgtcaggaataccaggcttagtacacagcactgaaagtagaaaccactccagccattcgtcatcaatttgaacaacacaatactgacccacattcccgtaatcgtatgaattgtcagcttaataatcccaaacatgccgagtcttttcctcctgaaaataccgataccgcctggcaaactgcgaaagagaactagccggtagcccggcagaaatcatcagggaagagtttcacatgaagcaggtgtgagatcctgaccaatattcaaatgcgaaatatgtcaggaaaaggtacctggcgaatgttgcgcaaactgatgtggcgttacaccataatattgtcgaaatgtgtttataaagtacgatgtactgctatagccacatttttccgcaatagtatgcagaggaatttgacgtaactcgagtaatcgtctggccatcgacatcctggaggcgagtaatattttactgaaacaggtattttcatcctgcaacttttttttgattagactctcgctggtatacattctttccgcgatatcgcgcagataccaacgtttggcgatatcaaagctaataaggcgttcaacttttcctgaaacagtgctgatgctattgaaaagtaaggggatcagttctttcttatgagaaaacatcgataaacaggaaaggtagagcatattgctcagtatcggtgaatttaccccggattcattgaagctatcaaaaatcgccgtcaccagcggcatggggggtgactggttaattaacaaacggtctttgctgtgtaaccctaaattgcgtggtagctgacgaatattttgtaagtaatggcaaactgtcagctcatcgatatccagtcgtcgcgtatccggtgaacaaaacgcaaaatcgtctgccaaatttttctccagcagcagaatactctcgttatgcagcgatattttttgctgttcatgataaatatcgaatgaacgacgaatgaggatcaccgagcagacatgagtcatgattatcccttatatttcatactgcgattatttcaatttcagtatactaatgaaatgatgccagactgtttcttagcgcaaaaactgccagatttggtaggaccaaaatttatccacaaagtagttttgcataacagttaattgataataagtaaatgcagcacgaatatattttcgcacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaattcccttgcgcaacaatacttgccgccgagtcacggttcgacaatctctgcgccgatcgctcctgatactctgtgggcgtcatcccataataatttcgaaagacgtaaatgaaatacgacacgctgtgatatccacaggatactgcaactcgcttaattgaaaaaccatgtataacaataagttgcaaagcacgttgcattctacactcagtaagcaactgtgaatatgatgtctcttcttcgcgcaattttttctttaacagacttggactcatcaacagctcgctggcgattcgggctagtgtccactcatgggcgatattattattgataaccgtacaaactcgtgttcgcatgttcggttgtaaaacgttcagaagcagcggtataaagtgctcatcctcaagaaaaacagataacaacgcaaagattaatgctcttttacgtagcatttctgcatagcgaagattcttattctgcgatagttgcgcaacttcctgaaaaacaggaatatctctactacagtgatgaacgagtaatgaagaaacttttttatgtgcatgaagatttaatgcctcctccttgagcatcgggagaaataatgaaagcgtgtcccttgacacgaatacaaaattttcaacacacttatctactcgaatttggcttgcatccgcaaaaaccaggtcaccgccattaaaatagcgatattcaccattaaccatggtgagaatatatttatgtcttgcatacgcaattagacaattcccatgtagtgattgcatagttgacttaatattacataaacatattactgtttattaatgtagcacgccgccctcttaagtcaaattgattgataaataaatttaaacgaagcgggagaacaggatgataatgtgtgatgttctacgggcaggatgactggatttataatacaaaaacgtgtttaagaacacagggaaattaatagtaagcaaataatcccttttcgtgacattaaaggtaatcgctacatttaataaacattcatataacatatatcttatcaacacgatgaatagacagccaatatattattgcgattaataagcaaccgaatgcccagctgtttttttaaaggctgggcattcggtttttacaacgttatgttatcaggtgtgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtgtcggcctggaatttatccagcgcatcgtgcagcggttgtgggaactcatagttaccggtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcgacatcatcgcgcatttcgtgcagcggaaatcgttttgactccgcgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggcattacaggcttaatttaaataacaaaatcctaagcagaaaaacgactttttataatataaacatttaacatgataatattaaaaacagactttattatcgtaataaaaatcgcccaaacattgctgttcgggcgatcaaattaattattgtttatcctgcatatacggcgtgtacaccccgttcagactgtgcaggaaagctacgatatcatccacatcctcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtcacattcatacgaccaatatccgccgccgtaatttccccaaagttaaagtcttttttcagccccaacggttcaaaggaacgtccgccgagaataataccaccatgacaagttgcacatttattatctttaaataattgatagccttttttctgttgcgccgtcagcgcattttcatctccgcgcaaccatttatcaaatggggaatccggcgtaattaatgttttctcaaattcagcaatggcatcagtaatattttcgccactgaaaccttgcggatagacttcgaggaactgcgttttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctgccatcgacgccccccgcattcaacgcatggcaatgagcgcatgaaatggtgctatcagccgataaacggggatcgtgatacagcgcaaaacccaacgccactttttgcgcatcggtaggcagtttttgcgggatgggctgcaccggttcattgcgatgttccggagcagtatcattgctggcgtaatattccgcgcgctgttttgcaatccaggccagtatttccgcccgctcttcatcactcaccttacccgcccagtgtagcgcggtataacgcgttggtggcatagtttcatactgcatcacccattcaatcttattcaaatcgctttgcgaaacgggtttatcagccagcagtgccgcacgcacggcctcaaggttaaaagatttatatccaagcttaatgtcgtaatccatcaactgtttcgcgccaggaatataataataggcgggtaattctgccgaaggcgtgtggcaatagtcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttccctcacggtggtgagttattgtgacccagaaaattttccagaatgctgcaaacgtctctgcgagacaaagccatcataaaaaacagggagatacgctttttgataggaatcaatcaattacatgaatataaactatcaataagatagcctgtgcctattacccagatcaggaatggcatatcatgattgcggcgagagcaggattgaatgttctgaaaatgaaaaacaacaccaaatcggtatttttataaattccattgatattagtgcgttatattttttgacaggttaataaacgtgatccaccgcacgctttgtcgcccaccaggcggagcgaatgactacccttaaagaaaagccgataattagcgacgaatttcggaggttggatccttatgctcaatcagaaaattcaaaaccctaatccagacgaactgatgatcgaagtcgatctctgctatgagctggacccgtatgaattaaaactggatgagatgatcgaggcagaaccggaacccgagatgattgaagggctgcctgcctctgatgcgctgacgcctgccgatcgctatctcgaactgttcgagcatgttcagtcggcgaaaattttccccgacagtaaaacctttcccgactgcgcacctaaaatggacccgctggatatcttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgcgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggccgataacttcgcctggatgatcgaaaactacggtcacatccccaacggcaaccgcacctattatttgagccgctcgcaaccaccggtttttgcgctgatggtggagttgtttgaagaagatggtgtacgcggtgcgcgccgctatctcgaccaccttaaaatggaatatgccttctggatggacggtgcagaatcgttaatccctaatcaggcctatcgccatgttgtgcggatgccggacggatcgctgctcaaccgttactgggacgatcgcgacacgccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaagccagtgcccgtcgcgatgcggtaaaccgttacctctgggatgatgaaaacggcatctaccgcgattacgactggcgacgcgaacaactggcgctgttttccgctgccgccattgtgccactctatgtcggtatggcgaaccatgaacaggccgatcgtctggcaaacgccgtgcgcagtcggttactgacacctggcgggattctggcaagcgagtacgaaaccggtgaacagtgggataaacccaacggctgggcaccgttacaatggatggcgattcagggatttaaaatgtacggcgatgaccttctgggtgatgaaatcgcgcgaagctggctgaagacggtgaatcagttctatctggaacagcacaaactgatcgaaaaataccatattgccgatggtgttccccgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttcacttccagacggcgatacagggattccagatgcgcttttaccgttccggtactgatattcagcgctctgccgatctccttatttgattcgcccgccgctaacatggttaaaatctcccgctggcgggcgcttaacgatttgagatctttaatgtccttttccggcgtcgtccgccagtctccaggcagaaacatcatccccatcgccgcactatttaccgccaacgcaaatgtctcgacggttgaatcacgaggcacaatggccagcacattaaaatggataacttcctgtaaccaccgtttattgcaatccgtcgccgtaattaacaccttaacctcaggaaattgcaccacggttttttgcagcaaccagtagcaaaactcaccatcctgatcgccatcgagcataactaaggcttcagggtaactttccagcttttgccataactcgtctgcctgactggccccctgaatactcactcctggaatacgctgctgtaaactgattttcattccatgaataaatattgactgcctgtcaaacatgactatttgcataactgaatctccacctgaatacgttaaaaagacttaagtagtggaagggtattacccgcgagaaaaaataagaattcgccatttggcggtggccattctacagagatgacgtgtagaaaatagttaccgatataaatagttacagctaaacgcctgaaattacatgtcgagggcactatttaaaacaattttgaggatttccttatattggtggttagtacgcatgcaattaaaaatgaaattccgcgaccacaagccaaaataacaaacggcaaggagacaaaaataagcacaaatagccaacacgtcctctgttcactttaaagggaatcgctgaaaaatacgctctgtttaaggggattcacctttctcagaaagctattccgcccttttcctgctgagaaatcgccacattcggcatgacaacattgtgaaacccggcattagatgttagaaaaaacaataaacaatgcgatatgcgcgttactgtttcgctgtgaacaacaatcggtcaaagaaatggataaaattcacgcaatgcagttgttcatcaaagtcgcggagctggaaagtttttcccgcgcagcggatttctttgctttgccaaagggaagtgtttcgcgccagatacaggcactggaacatcaacttggcacccagcttctccagcgcaccacgcgacgggtcaaactcacgccagaaggcatgacctattatcaacgagcaaaagatgtgttgagtaatctcagcgaactggacggtctgtttcaacaggatgccaccagtatcagcggtaaattacgcatcgacatcccgccaggaatcgcgaaaagcctgttactgccgcgcctgtcggaatttctctatctgcatccgggaattgagctggaactgagtagccatgaccgtccggtagatattcttcatgatggttttgattgcgtgatacgcactggcgcgttaccggaagatggcgttatcgcccgtcccctcggcaaactgaccatggtcaactgtgccagtccgcactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcaccgccggtcttgccggtctggggattattcagatcccgcgcattgccgtgcgcgaagccctgcgtgccgggcggcttattgaagtattacctggctaccgtgccgagccgctctccctttcgctggtttatccgcagcgtcgggagctttcccggcgtgtaaacctgtttatgcagtggctggctggcgtaatgaaagagtacctggactgaccgactatactttttaagaatgaccacgacagaaggacaaaagagcggatgacgcaggaaaacgagatcaaacgtcccatccaggatctggagcacgagccgattaagccgttggataatagcgagaaaggcagcaaagttagccaggcgctggaaaccgtcaccaccactgccgaaaaagtccaacgccaaccggttattgcgcacctgattcgcgcgacagaacgctttaacgatcggctgggtaaccagtttggtgcggctatcacctatttctcatttttgtcgatgataccaattttgatggtgtcgtttgccgcagggggctttgtgctggcctcccatccgatgttgctacaggatatcttcgacaaaattctgcaaaacatcagcgatccgacgctagccgccacgttgaaaaacaccatcaacaccgccgttcagcagcgtacgactgtagggcttgtcggcctggcggtggcactttattccggcatcaactggatgggtaacctgcgtgaagcgattcgtgcccagtcgcgcgatgtctgggaacgctcgccgcaagatcaggagaagttctgggtaaaatatctgcgagattttatttcgctgattggtttgttgattgcgctgattgtgacgctttcgatcacctcggttgccggttcggcgcagcaaatgattattagcgccctgcacctgaacagcattgagtggctgaaaccgacgtggcgattgattggcctggcgatttccatcttcgccaactatctgcttttcttctggatcttctggcggttgccgcgccaccgtccgcgcaaaaaagccctgattcgcggaacatttctggctgctattggttttgaagtgattaaaatcgtgatgacctacaccctgccatcgttgatgaaatccccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtaaacgccttatccggcatacgattttattcggcctggctccccgtaggccggataagatgcgccagcatcgcatccggctataatgcgcacataacctcttgaaactcgtccccagagcctcttcagccatctatttgggagcaaacaatttcattccaactcataaccccagcatataaatccagttggtaacttttatttaacctgaaaccagttttatccactatttataaaattatgtgaagcatttcatagaagaaaaatcactggcctaaacattatcccctttttgcctgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacagccattgagttcttcgacttttacatttacgccactgcggccgttattgtgtttccgcatatcttcttcccgcagggcgatcctacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccgggctatgccacgattggtattttcgccccgctgctgctggcgctggctcgatttggtcagggtctgggcttaggcggtgaatggggcggcgcggcgctgctggcgactgaaaacgccccaccgcgcaaacgtgcactgtatggctcctttccgcagctgggcgcaccgattggcttcttctttgccaatggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggcctgccgcgtaacgaagtgttgtggatgttgatgatggcagttattggttttggcgtgatggtgccagtcgctggattactggctgatgcctttggtcgccgtaaaagcatggtaatcatcaccacgctgatcatcctgttcgcgctgttcgcctttaacccactgctcggttctggcaacccgattctggtttttgccttcctgctgctggggttaagtctgatgggtctgaccttcgggccaatgggtgcgctgttaccagagctgtttccgacagaagtgcgttacaccggagcatcgttctcttacaacgtagcgtcgattctcggggcttccgttgcgccatatatcgcagcctggttgcagactaactacgggctaggtgcggtggggttatatctggcggcgatggctggcttgacgttaatcgccctgctgctgacccatgagacgcgacatcagtcgttgtaataagagtgaaaagcctgatgcgctacgcttatcaggcctgaatttccatacaatatattgaattcgcaaggatttgtaggccggataaggcgttcacgccgcatccggcatgaacaaagcacactttgccaacaatctaaatctgtttaattgccggatgtcagacatccggcaattatcatcacttcttcatctgcgacaaaatcgtccgacactgattagcctccccttcggaaggtgagatcagtgccagtaacgccgccgccggtgttaccagcgttgccagtgccgcagcaacagcaccacgggcaatcagcggtccggctttcaccccagcctgcggatttttaaacgtcccccgcacatacagcggcgaacgcagtgtgataatccgaattcctttactctccggatcaatagtcaaatccagctgttccgaagcaaaacttgccgtgccggtaacattaatcaacgcgttctcagtatcgaaagcaaaaatctgcgggcgcgccacgccgttggcaatattcagattcgccgccgcgcagttcacccgcacctcatcatcaccaaatatcgcaccgacaatgtagttgccgacattcagcccaacaatctccatcaggttgcggctcaccagcccgtcattcatcaacagtttcaggttgccgttactgttgcctaaaagtgccgccaccgagttaccgctaccgcgtagttccgcgtcaccgttcatttcccccagcgtcttctgcatcagttccacatcgggcatcagttctttcagtttcagtcgacgagcctgaatatctgcccgcccctgcatcggctttttatcgccttccagatgaatattcgccgcaatgctgccgcccgccatgccaaatttcagcggttgcaggcgcaggtcagcatttttgaggatgatatgagtagaaagatcgctaatcggcaggctactgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggctttccggtggtgtagaccagagaaccgtggatatcgctatcaccaattcgcccattaaaaccgcgataatcaaagaccgacgatttttcagtgtcgattttcgctaccagccgaccatccgtttcaaacggcggggtatcgggcagcagaacgcccgtcagttcatagagatcacccagtgaatcgccagaaaatttaagccgtaaatcgacaccgcccatcttcattgggtcattcacgacgccatcaaaagcaacacgggtgttaccagagcggaaatcagcctgtaccggaaacggcgtcccttcgccacgcagcgccagcataccgcctatttttcccgtacccgtgagcggttcaccgttatatcgtccctgcgccttcaggccaaaaacgtaatcgcccaccttttctttatccgctttacctttcgatccagtaacttcgctgaacggcagcggcttgcctaagggatcaacaaaaatctccagatccgctttgcttactttgtcatcaatggcgatccgcccttgatcgaaaagaatattatccagccgaaacgaccatgccgacggctttgcattcgcgtctttgttatcatcgttggcaagattaaacgtccagttattgttcttttcagagaggcgaatcaggcgcgcgtcgggcttttcgagcttgatccacggcagccagaccgttttggtcagcagcgccagcggggccagcgttgcctctacgcgtggcaaatgcaccatcgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatagtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcagcttatagcgccagaaccgccgtattcagcgtttctatcggtgccgggcgtgaaagaaaccagccttgtgcggcgaatgcgggcgagttctgaacatcacgccactcttccggcgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagcgcagagaaatttgccatcccggtaccaaaatcatccagccacagcgggccaaattcacacatcgaggcaaaggttgaatctttcggcagacggatatgctccaccagttcgaaacgcagccagggaagacgctcaatctggcgcaggatttttggttgctgacgcagggcgatgagcgtagggccatcaatattgaccgatgccagcaggccgtgctctataaagaagtcggctttttgcgccagcaaatcaatctgctctttcacaacctccatccgatggctgacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgtaagggcagaactttaccgcctggccggggtaaatttcctcactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcacggcgagaacgttgatacttccctgacccaacggatggaaaaccgtctgccgggcctttactacattgaaaccgacagcaccggcgagcgtacgttctactactggcggaacgaagccgccgccaaattctggctggagagtgagcagtctgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgacgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtgaaactgccgaaagaaaaagtgatcgataccaccgcagctggcgactctttcagtgccggttatctggcggtacgtctgacaggcggcagcgcggaagacgcggcgaaacgtgggcacctgaccgcaagtaccgttattcagtatcgcggcgcgattatcccgcgtgaggcgatgccagcgtaaacgcagcatatgcaaaaggctggataaagtgttacccctctatccagctcatccataaatacctgatggttgtgctaactcatcaccatcaggcattactgtgcaggtggaatatccgtcacttcaggatgtacgtcatccgtggcgacagaggtggtcgcagcggcggtagatggggccatgatttgatcccagaccgcctgcaacgctttcatgttaaattccggctcgcctttcggctgcagcagtattaacgccatatcattcgacaactgttgacgcagatcctgatttaacatctctaccgtcaggctattaaggaaatcctgccgcagtttctgatattgctccggcgcgatatcgacaacctgattttgcaacgaacgcatccgctgacccatcagaatatcggtatcagctcgtgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacggcagtcaaatccaagaccgatgtctttgctgttactggcacttaacgcttgctgaacatgccagaacagcgcctcgcgggccaggtccgcacgccagtagcgcagcagtgcggctgattcacgaatcggctgccacggcgtatcccacatgatagataaccggtcctgacgcaccgcgtcagtcataatactcaccgcttccgcacgcagcggagaaagcgtcggcaccggagctggcgtttcacgtttgcctttcagttcgccaaacgttttgtttatttggtcgacaaccgagcgcgcatccacgtttcccaccaccagtagcgtcattgcatccggggtgtaccatttctgatagaaatctttaattttttccgcttcaacgggttgtttcagcggatcggcaggatcgtgacctaacaaggttgaccctttcagacgatagcgccaccagccctctttagtatcggcaggccaggttgccaccatgtcctgactttgcagcgcgtggttgatggtttctggtgtgatggtcaatttgccagtggcatttgccagataagagagcgcttctttcagcaaatcgttacggttattgggcaaactcagattaaacagcgtggtgtcataagagacaattaccggcggcatcgggcgtttagggtcgatcccctgctgccacaatgaacgcgcctgtgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgctggggggtggtcagcacttgccactgtaaaccgttggaaagcgtcccctgttgccatgctggatcaggctggagcgcatctgcctgcacatagccagcagtggccatcatcagcaaaccgcccgctaaaagtcgaatttttgtgccctgcatgtgaacccctgatcaactatcctggtaataaaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtgatgagattaagaggataattcgtgcgttttgccatccggcgcacgattattcagcacatcgtccagttttttgtggtccagttctttcacccacttagcaacgacaatggtcgctacgccgttaccgaccaggttagtcagcgcacgagcttctgacataaagcggtcgataccgaggatcagcgccagacccgctaccggcaaatggcccaccgcagagagcgtcgccgccagcacgataaagccactacccgttacccctgccgcccctttagaagaaagcagcaacacgattaacagcgtgatttggtggacgatatccatctgactgttagtggcctgggcgataaacaccgccgccattgtcaggtatatcgatgtgccatcaaggttaaacgagtagcctgtcgggatgaccagccccaccaccgatttacggcagccgagtttctccatcttgtcgagcatacgcggcagcgccgactcggaagatgaagtccccagtacaatcagcagttcttcacggatgtagcggataaatttgaagatactgaaaccagtcgctttagcgattgaacccaataccagcaccacaaacaggatacaggtaatgtagaaacagataatcagctgccccagttgcaccagtgtgccgacgccgtatttaccgatggtaaacgccattgccccgaacgcaccaataggtgccagacgcatgatcatattgatgatgccgaagatgacctgcgagaaactttcgatgacgttaaaaatcagttggcctttgctgcccagacggtggagcgcaaaaccaaacagtacggcaaacagcagcacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaagccgtcgccaagcggtttcatttgctcgcctatttcaggatagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgcccgcttttgccagccagtcgcgttgtgcttcagtctccacgccttcggcaatcatttgtaagttcaggctctgcgccagcatgataattgcagcaatcatgctgctatctcccggcaagccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgagggtcgtcaatacgtcggctttctgtcacttccagaatcagtgttcccggctgaatgcgatagcgggttaacagttccagcatatccgccaccatattcgggtgcatcagttgcagcgcagagaggtttaccgacaagggcagcataatgccgcgctcttgccaggctgcaagcaatcgacaggactcttccagcacccagtgaccgacggtaaccatcagcccacagcactcaatgcgatcgattaagccatccggcaggtcccaactgccatccggttgctggatacgcagtaacacttccgcactgaccagtttaccgctggtcatctcgacctgtggctgtaaccaaatagcaaactgatgattttccagtgcattaaggatatcgctctcttccgtcaaccgcttctgggcggcttccatctgctgcggatcaaagaactgaatctgattcttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaaggtgattgcgtgccacggttcctgtacaccgttggcaatgacagcaaagtcataaccgctaatctgcgcgaggatcatacgtggcgacagtaccgatttgagtttttccaccagcgtcagcagcagaatttctcgttgcgcctctttcagcacgcccgcagtatcacgcagggtttcacaggtgatgatcatcagcgcggtggtttgtttacgcgcgacaacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctccttggctgggatggcgttaagttcgcgagcaatattgcgtaacggatgcaaaatcaggcggttaatgcaccagctgatggcgacggtcaggataagcgacaaaagtaagtaaatggtcactaacgttgagagggtgctcatcacgaacttatacatacggaaggaatccgcctgtagtaccagataggcaattggctgcgggtttgccggacgttcgagcgagtaaacgcccagcgagatttgaaccggtagctcaaacaggcgagtaaccattaccggcaccgggcgctctggaataaaacttttacgcagcgcctggaactggttaggcagcactacatcggcacggctgaccacgcctgccggtttaatgctggcaagaatagcttccgcttcgggaatatcgcctttcaaaatagctgaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctccccccggaaatcccagattgccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggtgcgtaatctttcgcctgctggatatcaattgccgtgccaacaaaccagttggaagtaacacgtcgttcaagtaatgcccgcgccgtgtagccgaagccctgactgctgccgccatcgttggattgccgcgcagcttcttcctgccagtcggtcgggatcagattcatcagcggataacgcggcatggttttggtgcgtgaatgcgaccacgagccagacgcacccagctcccacgaccagttttccgtgcgctcccgccacatcaccggtatggcaaacgacaggtattcctgcggactgtagtaaccgccctgaccgagtgagtagccactcagatctttgtcgtaatgccagatcatgttgttcaggccgattgtgacgcggcgattgttctggttaatgaccttatagtaatagcccgtcatccagcgcacgcgccagttatcttcgacatttttaccggttaactggtcgccactaagcgatgcccagacgccgtttgcttcacctttatcgtagctcagacttagccccacaccgtcggcacgtacgccaccccattttttcccggtattgctcggggagtctttttgcccaccaaaggccagcaaagaactggagatgggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgctggcaccggaatccgactggctgcggttgccgctacagtcctgtaatgtacaggtgccccagttgtcatcccatttgccatcggcattagtggagaaactgccgacgttcatattgacgaaatcactgcgaaagaacatccgcccgtcagaatacggcgcatccacctgcaacatggtagtgtgcgctttcagatcggagtaaccaccggtgccgctcgaaccccagtaatcgtgctcaagggtgacgttaagatcctgctggcgatagaggtccgccgcatcgctgcgcacgccacgtttcagccagtcatctttctcgtcgttacgggtcagtcgggtaaaggtgtcgttatcctgcggacgcgtcgtagtcacaccggatgcgaccatggcgtctttgtaggtttccagcgcctgcgttggatcgcccgcctgcgcttcaaacttcgcaccatcacgcagcaccatcgcgctttccatcgacggtggctgagattttgcctgcgggatcaacttattaaacgtccgctgcgctgctgcggtatcgccaagctgcgcctgtgccagcgccacgcgccgctgtgtgttcagcgaggcgttatcggtagcgggcagtttcgccagctggctacgtgccgccgctttgtcaccggcagcaatatccacttccgtcagaccaagaatggcgtcggcgttagctggctcccgcgtcaggacattctgatatgcagcgcgggcggcggtgtaatcacgtcgttgttgcgcccagtcagccagcgtgaggtcaatacgcgtggaaggtggttgctggcgcagcatcgcttccgcttctgcctctttgccgctttctcgcaggcggttagcggtttccagcacctgatcgctttgcagtcgattaaccagctcctgaatattgctgttccactgcgcacgcggcaggctattgatatgcgccagcgccgctctgtcctggtcatgaccagagaggtacagcccgtaagcgtaaacctgctccgggtcgttcgacttctgctgcgccagattgcgcattaacgtatcggcctggctgcgttgtccggcctgccagagatcctgcgaaagtcggtaagtaatccatacgctgccggggtccagcgccagtcgttgccgctgaagtgctgccgcctgcgcccatttgccctggttttccagtgcctctgcctgctgtgccagacggtcgttttgcaggctgcgttcgatatcatcaatgctacgccgctgactggcagagagcgaggcgataaacgcttcagctttttctggcgattgctggcggtaaatatttgccagcccgcgcacggcgttagtgttgccgctgtccatacgcaaggtctgctgataataacgttcggcggcgggataatcttttcgcgccatcgccacatcgcccagccccagcactgcataactgtcggtgttatcgacattacgcgcctgctggaacaggcgttctgcccggtcaggattattggctttcagcgcagcatcgccctgctggatcgccagccagtagcggtttactttcagcagactgttccatttgtcgttgttgctgctgtgcgggtccagtgcgagggctttttccagattcgccactgcattggcgcgatcgcctttctgagaatacgcctggcccagcgcccccagagcttcactgtctttcgggttcgcccgcaccgcctgttgtagttcgggaatggctttacccgccataccagagtccaccgccgctaaaccttgcgcacgagcgcggaaagcaggatcggccagctgtttttgctgttctgccagttgcgattgcgcagccgccacgctatcgccatcactaaagatcgagagatattttttcagcgccgacacactggcatcactgacgggcatgtctttaatctgcccgtaccagattttagaggccccttcgcgcccggcgttcgattttgccatctgttccaggacggcaaaaccttcgtcacggcgatcgctactaaacagcaatagcgccagattgttttgcaggcccgtattgcccggtgcatccgcattgatgcgttttaactgattaatcgcttcgccacggcgagccggaattttcgccaccgtactccagtactcgacagcaatgtcaccttccggcggcgcaccgttgaacagtttgttgtaactcgccacagcttcttctgcatgaccggtcgtcgcctgcaatcgtgcctgttgcagtgcctgacgaccatccggcgtggaaagtagcatcgtagtccgcgacgatttatacgcatttgaactcggcgctaactgcgacagccgatcgagctgtttttgcgcgccatcaatatcgccctgacgtaacaaagaacggaaacgggcggcaacgacgtccgggttattcggatcaataagttccagccgatataacgactgttgcaccagatcttcacgatgggtcgcttcgcctaaccgaacttgctccagcaactgttgctgagcggttggtgctgcctcgaccatcggcatgacggccagaccgagggaaagcgtgaatatgtttagtgtgaatttgcgcattcctggccccagtcaggtaataactcaccttttgtcgagaagcggaaacggtgttgatcccagccttgtccaaacagggtcagcacatagttgtaataggcatcgctgccgggaaagttatcggccacgcgctggcgctgaacggcctgcgcatcgcggttttgtaaaaagggcagcatggcggcagaaaaaccgactggtcctttaccctgcgctttccccgtagccacatccactttttccggcggataaccgtttttctcagtgaatgtcgccatcggtttaaaccggttgagcatccgcgctttttgcggatcgctgtcaggcatcatgcctacccacatgtaaacgcggatagcgtcgtagctgctgatcaatgttttttcggcttttagctgccagcctttgtctttctcatagcgcacccagtctggcgaaaaacctttcggggcggtttccagcaataaacgttgattggtttcgcgcagcgtggtccacggcgcgccaaagcgggtgaaatactgcgccagcgtcggcggcaggtagctggggttaaaacgccagctgttatcctcagcaaaacccactttgcccggtaacaacatggaacccagcccaggcaccgtcaccacttcctcccgcgcgatacgttttagcaacgcgctgccgatgtcggtataacgctgctctttccacaaacgccccgcctccagcaacgaccaggccatccagacatcaccatcggaggccgaattgctgtccagcacttcccacttactgttctctttcttgccccacagccaggcgggcaaacgttcttttaaagaaccctgagcgagattgttctgcgtccagtcgagaatattatcgaaagctgcacggtcgttagccgccagggcagagaacatgccgtaactttgcccttcggaggtggtgattttgcgcgcgtcgctggggtcgatgacgcgcccttcctgactgatgtaatcctttttaaactgctcccaggcaggccaggtacaggctgcctgaacactaaaggcagccagcagcagcatcgtcacgattccactacgcaacacattcatcttcaattactcgttatccgggttaagacgacgacgactaataattcgcagcagacgccacagtacccatgccagcaatatcacactgatagccgccagcaccgccagcagaatcggatggtttgccagcgcataccacacgcgctcgaaccacggcagatgacctacgtaataaacgtcgccaacacgtaggctgttgataccggactcgcggatcaccgcgaccgaaccgaacatggtggcgcgtttgccgctatcgttcaccgcatcgttaagcatttcataaccgcgtgggctatctgccaacagcgcaatcacgctgcgctggtcgttatacggcgactggaagccaatcaccgccgccatcgcaccggaagaggtcagcgttgaccgggtttctgccgcgcgatcgctctcgtccggcacaatgccggggaacggggtctggcgcatcggtgttttcacccagctttcggtcgcctgcaccaataggtcgatctgcttatcgtctttcagtttgtccgggataccaccgatgatcatgatgtcggcatctttgccctgaatggtgctgccatcatcggtcaccgtcagattaatcgccgggaagcccgtctgtgcgccgataaaaccaacagtattcagcaacgtttccatctgtgcttcgttaggcgctttcggcatcacggtgatggtttgcgacagatccgccatccggctgaatgggaagcccgcgttagcaaaggcgcgtagatccggcatcgggatgaagtggtaatacttcgagaagtcgatggtggagtcgtcaccaatcaccacatgattctgcaccggctggaaggtaatacagttatccaccgaaccgcccggcatcgggttcatatactcaaagtcgaagcgcagctggttggtcgcgcccagtttcagcgccggaatagagacatctgttttgccatccagcaaaccttgtaataccggaatccgcagcagcaggcggttcgcctcctgtttgctgctcaggttgaaggattgcaggaactggttattcaggctgatatccatccgcgaactgtctttcaccggcggcatggtgtagcggtaattaatatccatatcaatgccggtactgcgcatcaggtagagatccggcggcaggtttagcgaaacgttaatcgctgctggctcaagaccgctggattgtaactgttcttcataggttttcagttcgccaaatgtgaccggacgatcggtacgtacccagttcggcgcatcgtacggcttacgcggtagcagcggtttcacttcattcactaccacgctttcaccacggaacagaatgttaccctgagcgatacctttcgctgcctgcaacaggtctttgtcgtcacgaccaaacaccaccagcagtttgacgtaaggattctgcggatggttaatcatctcaatcaccggggcttttaccgccggatgatcgcgcaggaagtccggccgtttgtcgttggttgcaaagacaatggcattgcgatccggcagttggttatagagtaccgggaagttctgcccacgccagccagaacgcgaaccaaaccacgaggcgacaatggcagaggcttgttgcagcccaacatccggcgcacccgcaaagaccatcggcaaggtgttggtgcggttatcgctcgggtcaaagaatggcaccgggaagtgtgacaggtcattcttcacattcagggtctgataggtcagatccagtccactgctccgcccaacatccagccaaagcgtggtgctggccggtttttcgcacacgtcctgataatggccgacaaactccagccgtacacggttgaagtcgctaataaacagtgggttaatgggcatttgcgccagcgtttttttacccaactgttctttggtcactggcagcacgcccatcagttcatcattgagataaacctttaactgcgactggacaggcagtaacgatggcgatggggtgtattcgaggttgagcatcgccttcgtcaccacttcatcgctgcgcataccaaactcaatgctgccgttcgggttaatgccacgtagcaccatgctgcccggcggcggtgcaatttgcgcaaaggtcagcttcacatcacgcgaaggaccgttctgcgccacgactggcgcatcagcgccctgcacgcccggcatcacttgccccacctgcggattttgttccgtctgggcggctacagctggctcagcattgatcagtggttgcgttgctggcgtcgcctgcgtcatgaaagaggggaacgcactcatccccatagccactgcacaaatccagaatagttttcttttcatcgcgttatcatcattgttgagccaaagcctgatccgatggttgtgccgtttcgctccgctccgggcggcgcggaataaacgatacaacccaggaaaccagagaagtcagcacacggaatatgcccttcaccgaagaaggcgcaaactccgccagatggcggtagccacggaagccgagcttcagaatatccagcagactttccagcggcttatcttccgggtagctgtcctgccagagcgcccatgtatccgcacgggcaaacgtacactgcacaaaatcgatatgttgctgggtggtgagcggcattaatttcagcccaacttcattacccatcacgcgcgccacctgggtcgggaagacgtattcctgctgaccgcgtttaagcaacagattcactttctgcccttccagaatctgcgcctgaccgttgatcttgatccccaaaccaccgtcggagaaatcctgaacggtacacgagaagaggtgaccatcttcgcgggcaattgccgcgggcatcgtcatctccacgcggtgcgatcggcgtacctgtttgctttctaccgataccgcaactgcgccgccaagaacaatcaggttgtagaacacccacaccatactgacgaccacggtgagcatctcggttggcgggccatagaagtagcgccagatgcctaccgcaacgcccaccaggttgagcaggacaaggaagatgtagggccgcgagatcacccagtcgacgtactcttcttccaccagtccacctttggcggtgacgttaaatttgcctttgtgcgggttaatcagcgccaccagcgtcggtggtgcgatataccacgccagcaccgtttcgtagatttcactccagaaagagtggcgatatttgccctggatcttggagttggtcaggctggcatggatcatatgcggcagcacgaatagggcgatcatcaacgctggcgcatagatgatgtaggcatgaagcagcaggaacgccagcggcgcagtcaggaagatcagccgtggaatgcccgacaagaagtggaacatggcgttgacgtaacatagccgctgagcaaacttcagccctttaccggtgagcgggttatcgagacggaagatttgtaccatcccgcgcgcccagcgaatacgctgaccgatatgcgccgacagactttcggtcgccagccccgccgcctgcggaatacgcatatacgcggaggtatagccacgacggtgcaaccgcagagaagtatgcgcatcttcagtcacggtttcgacagcaatgccgccaatttcatccagcggcttacgacgaatcaccgcacaggaaccgcagaagaaagtggcgtcccacatatcgttgccatcctgcaccagaccatagaacagcgtgccttcgttcggcgttttacggaaacgccccaggttgcgttcaaacgggtccggtgagaagaagtggtgcggcgtctgcatcatcgccagctgtttttctttcaggaaccagcccatggtcatttgcaagaacgatcgcgttggtacgtggtcgcagtcgaaaatcgacacgaactcgcctttggcatatttcagcgcattgttgatgttgcctgctttcgcatgttcatgagtggtgcgggcgatatatttcacccccacgttttgcgcaaactggcgaaactcttccctgccgccgtcatcaaggatccagatattcagcttatctttcggccagtcgatacccagcgaggcgtaaatggtatttttcaccacgttgagatcttcgttgtaagtcgggacaaagatatccaccgacggccacagcgacatatctttcggcaatggcaccggctgacgattcagcggccatactacctggaagtagccgagcaccagcacaatccacgcgtacgtttcagcgaagagcagaataagcccgcacaccaggctgaccggatcgtcccagttcagcgtagaggtgtaacgccaccagatataacggcaagaaacggtcagcgacagcacaatcaacattagcgccgagaagcgccccggcatccgccgtacgatcagcgctaccccccacagcagcatcaggaagataaactgcgccagcgggttaaacggctgagtaacgcagattaacgccagaatcagcgagaaggtgacgatgataccgaggatcaaccgccgcgccccggcactcaaatgaccgagctcttttttctcatccagatgctgtgttttatggctaacgcgctcaggcagctcgttcatccattgatggtaacgtccacgaatattttgcagacctgaaaatgcccgcctgcgcggtttcggcgtttctttgcgcgatgcaccgatcaataaccagcatgtttgaatgagataacggaccgggtccagcggacgcggacgcgaggcgttgatatgcggatacaggtttttatgttctgcgcgaatacgctgccagcgcgggtgctccagcggaataaaaatccaggccaggatcatccagaaacagccgagcgtcgcgctgaaagccgacgcaccgtgacgacgataatcgcgataacgcccgataagccgcgcgttgaccggcgggataagcaaccaccgggtcaggatactcatgatgcactcccgactggcgttttcagcccggagtagttcaacaggcaccagttcgccagcgtcagtatctcttcagccgccagcgcatcactgcgatattcacctactggttgcttagccgccaggcattcagccatcgcttcatcacgatgaatgagcatcggcagtaatcggcgctggctttgcaaccaaagctggtaaatatcgtcctgaacctgactgccaatacggaagtcattaatcaaaatatgtgcgccatccggcagcgcttgctgatgcagtcggatatggcagttggcatccacattgacgattgccagcgagtgatcgcacaaactcagcagctggtgggttatctgcgaggcatcacgcggtaagtcgattaaaatccactggtaacgcccgctggcttttagttgctgtaagccggagcaaatatcgctcagccgggtttgccagtgctgtggattttcttgttcttcaatggataactgaccaaaaggcagcaaatcgagctgcgaggtgtagcgcaacccagcgtcacgccagtcctggccatccagcatcgctctggcccagccctgacggtgggtaaaatcaacattaaatgacaggcgcaacaagttgtccgggcaggcatcgaccaccaggacattttctcccaacatttgtaatgaccaggctaatgcggcggtgatggttgttgtccccacgcctccccgcaccccctgctatcccagtacggccattcaccaatcccctacttttgttgcgcaaactctgccagcaacggccagcgttttaatgccgcggccaactgttcgcgttgggaaatatcggcataatcaatatcaggcagtgaaaatgcctgctttaacgccacaatatcattctggaagatatagcctatcgcgggatcaggcagagtatctggttcattgttattcattttgcttgatccctatgaaataaccgtaccgttcatgagacaattctaaccgtgagcatttcgccggtttattgtttacggcgagacgggaatttgctcactttttgactttccgttacgcaacagaaaaagttaaaaacgaaaagactaaaatcacacgtcttgtgaccttctaaattgattcacatgctaaatctgataagttttaatttcaatggtaggtttatttcttagctttcgctagtaaactgataatcagacaaaatggtgacatgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccggcgaaaatctttcaattagatgattctcaagggccggaaaaaataaaattattttcaatgctaaatcatgaaaaaggtctatactatttgacccgtgatttgcagtgttctattgatccccataattacctttttattcttgtttgcgcaaataacgcatggcaaaacattcctgccgagcggcttcgctcatggttggataaaatgaataaatggagcaggttaaaccattgttcgcttttggtaattaatcccggaaataataacgataaacaattttcattgttgcttgaggaataccgttcactttttggtcttgccagtttgcgttttcagggtgaccaacatttgctggatattgccttctggtgcaacgaaaaaggggtcagcgcccgtcagcagcttagcgttcagcaacaaaatggtatctggacattagttcaaagcgaagaggcggagatccaaccacgcagcgacgaaaaacgcattctgagtaatgttgctgtactggaaggtgcgccgccgctatcggaacactggcaactgttcaacaataacgaagtcctgttcaatgaagcccgtaccgctcaggcggcgacggtggtcttttctttacagcaaaatgcgcaaatcgagccactggcccgcagcattcataccctgcgtcgccagcgcggtagtgcgatgaaaatcctcgtgcgggaaaataccgctagcctgcgcgccaccgatgaacgtttgttattggcctgcggtgcaaatatggttattccgtggaatgcgccactctcccgttgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgaacaagccctgacgctgtgtcgccctaaccgtaccggcgatatcatgaccattggcggtaatcggctggtgctgtttctctcattctgtcggattaacgatctggataccgcgttgaatcatattttcccattgcctactggcgacattttctcaaaccgtatggtctggtttgaagatgatcaaatcagtgccgagctggtgcagatgcgcttgcttgccccagaacaatggggcatgccgctgcctttaacgcaaagttctaaaccggtcatcaatgccgagcacgatggtcgccactggcgacgaataccagaacccatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggcctgttgtgggcgggatatcttaacttccatccgctcctcaatttggtgtttgccgcgtttctgctgatgccccttccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgaccttgtcacacgctttattaactggcagatgattggggccatttttgttttattagtggcctggttattcctgtcacaatggattcgcattaccgtttttgtggttgccatactgctatggctgaacgtacttaccctggcgggaccaagtttctccttgtggccagccggacaaccgacgaccactgtaacaacgacgggtggtaacgcagcggcaaccgttgcggcgacgggtggcgcaccggtagtgggtgatatgcccgcacaaactgcaccgccaacaacggcgaaccttaacgcctggctgaataatttctataacgcggaggcgaaacgtaaatcgaccttcccgtcttcgctgcccgctgatgctcagccatttgaactactggtgattaacatctgttcgctttcctggtcggatatagaagccgccgggttgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctttcgaaactgggctttacccagcacctgatgatgggacataacggccagttcggcggttttttgaaagaagttcgcgaaaatggcggcatgcagagcgaattgatggatcaaacaaatctgccggttattttgctgggctttgatggttcgccggtttatgacgataccgctgtgcttaaccgctggctggacgttaccgaaaaagataaaaacagccgtagtgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaagaacgaaaaaggccgcagagtttcccccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagctctgcgaacgtcatatagccgcctgtgttgtaatgacaacgtttcgcggctattcttgagtggtctagagtcaagattagcccccgtggtgttgtcaggtgcatacctgcaacgtgcgggggttttctctctccagcaaccaatgccaccagggataaagcccccgcaacattgcgcctcaccggaacctttccggcttgccgctgattctacgattgctttttactgtcagcacccggcaatcttcctcattgcgcgatgccttccagcttaatttctttatttgcaatagttgcagttcatatccgggctgactccagactggtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaaaccggagcgcatggccccggttttgtgagttaacgctgcggattttcatcctgatcaacagcaaaacaagctaccagttgaccgccgtagtcttttagctgcggctgcaactgggtgcaggggccgaagcgccgacgacagcgggcgttgaaggcgcaacccggcggtggattcagtgggcttggtagttcaccgctgagcttgatgcgctcgcggcgatcgtccgggttcaggcgcggcgtcgcggaaagtagcgcctgagtgtacggatggcgcgggttattgaagatttggtctttcgttcccttctccacgcagcggcccaggtacatcaccatcacttcatcagcaatgtgctccaccaccgacaggtcgtgggagataaagacataagacagccccaactcctgctgcaaatccatcatcagattcagcacctgcgcgcgcactgaaacatccagcgcggaaaccggttcatcggcaatcaccacatccgggtcgagcatcagaccacgggcgatggcgatacgctgacgctgaccgccggagaacatatgcggatagcggtcatagtgctcggttttcaggccgactttcgccatcatcgacagggctttttcccgacgctgttctttgcttaagctggtgttgatcagcagcggctcttcaagaatttgcccgacttttttacgcggattcagcgaaccgtaagggttctggaagacgatctggattttctgccgacgcagcttctgcgcctgcggatcgtgcttaagcagatcctgcccctggtaatacagctcgccaccggtgggcatttcaatcatcgtcagcaaccgaccgagggtcgatttaccgcagccagattcgcccactactgccagcgttttgccacgttcaaggttaaacgaaacgccatccagcgctttaaccagacgttccggcgcgaacatgcctttcttcaccggataatgttttttcaggtcgatagcctgcaacagcggttgttgcagggtggcctcttgcgtactcatagtgtcggcctcccggcatcatcaagtgggtaatggcatttggactgacgcccgtcagcgagcatattcagcgccggttcttcagcgcgacatctgtcagtggcataggggcagcgcgggttaagcaggcagccgttcgggcggtcgtacttgccgggaacgacacctggcaacgacgccagacgttctttgtcctgagcaaattctggcagcgcacgcagcaatgcctgagtatacgggtgacgcggcgcatggaagatggcgtgcgcatcaccggtttccaccacctggcctgcatacatcacgatgattttatgtgccgcttccgccaccagcgccaggtcatgggtaattaacaccagcgccatgttctctttctgctgtagctccagcagtagttcgatgatttgcgcctgaatggtcacgtccagcgcggtggtcggttcatcggcaatcagcagttttggccgacaggcaatcgccatggcgatcatcacgcgctggctcatgccgccggaaagctgatgcgggtaaacatccagacgcgatgccggatcgggaataccgacctgattcagcaggtcaatcgctcgctgacggcgggtacttttgttgccgccctgatgcaccttaatcgcttccataatctggaaacccacggtgtagcacgggttaaggctggtcatcgggtcctggaagatcatcgccacttcggcacccaccaggttgcggcgctctttttctgagatacgctgcaaatcctggccgttaaactccagtttttctgccattacgcggcccggataatcaatcagccccataatcgccagtgaactgaccgacttaccggagccggactcacccacaatcccgaccacttcgccctgttttacgctgtagctgatgcggtctacggcgcggaacggcgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcggagagcatggtgccccactcaggcgttggcggctgtgcccccatgccgaggaaaccaagagcagccatatcgagaatggcgttagagaaaccgagcgacgcctgaacaatcagcggcgcaaggcagttcgggaagatgttaataaacatctgacgcatcgccccggcacccgccacgcgagacgcggtgacgtaatcgcggttaacttccaccagcacggcggcgcgggttaagcgcacatagtgcggcaaggcaacgaaggtcagtgccagcgcggcgttaccaatcgacgggccgaaaattgccaccagcaccagcgccagcagcagacttggcagcgccagcatgatatcgaccacgcgcataatgatgttatcgaccaggccgccaaagtaaccggcgatcaggccgagaataacgcccataatcagcgataacacaactaccagacagccaaccagcagcgacaggcgcgcaccgtacatcaggcgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgatgaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgtcccagaccgggccacgagaagatggtttcggtcagaatcgcccccgccagcaatgttcccacctgcaggccgataacggtcaccaccggcagcatcgcgttacgcagcgcatggacgataatcacccgcatgcgggttagccctttggcgcgcgcggtgcggatgtaatcctcgcccagcacttccagcatcgaggagcgtgtcatacgcacaatgaccgccagcggaatagtacccagcacaatggcaggcaagatcatatgggcgacggcatcgataaagttgccgtcttcaccccagatggcggtgtcgattagcataaaaccggttaacggattggagtcatcgaggaacaccatatcgctcacgcgaccggagacgggcgtcaggttccagtgcaccgaaaccagcatgatcagcatcatgccccaccagaagataggcattgaataacctgtcagcgccaggccaaccgctgtgtgatcgaaaatggaaccgcgtttaaccgcagccagcacgccgaccggaataccgactgccgtagcaaaaatcatcgcgcagacgccaagttccagcgtggcctggaagcgcggcacgaactcttcccaaaccgggatgcggcttttcattgaaatgcctagatcgccatgcataacgccccaaatgtaatggagatactgctgccacatcggtttatctaagccgagttcagccagcagctgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttatcggacagggaatgaagtattgctgccggatggcgctgcacgcagaggcacagcgccaccgggtatacagattgttgacaaagtgcgctttgtttatgccggatgcggcgttaacgccttatccggcctacaaaatcgtgcaaattcaatacattgcagaattttcgtaggcctgataagcggagcgcatcaggcatttttgcctttgccatcagtcttgtatggcttttaattattcgatagagacgttttcgaagtgatgtttgcctaatggatcaaccacatagcctttaacttctttacgtaccggttcaaacacggtggagtgagcgatgatcagtgccggagcctgatcgtgcatcaccacctgcgcttgtttgtacagttcaacgcgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctggtgctcgccatctttcgcacgcttgaggtactcaccccattcgtaggtgacaattttggcctgcacgccgactttcgcccagtctgcctgaatcatctccgccatgcggcgagcgttcgggttatacggacgttgtaccggcatcgcccacaggtcgatggagaaacctttttccagacccgcttctttcagcaaggctttcgctttttcaggatcgtaggtgtagtcctgaacgtcgtcgttatagccccacatggttggcgggatcaggtttttcgctgatacgcccgcgccctgataaaccgctttgatgatcgcgtctttgttcaccgcgtaggtcagagcctggcgaactttcacgtcatcgagtggttttttctgcacgttatacgagagataaccgacgttcagccccggcatttccatcagattgatggatttatcctgcttcatgcgagcgatatctgccgggttcgggtacggcatcacctggcattcattcttctgcaatttcgcgtaacgcacggaagcgtcaggggtaatagagaaaaccagcgtatcgatctgcggtttggtgccccagtagccatcaaacgctttgtagcggatacgggaatctttttgatactgctgtaactggaacggaccggttccgattgggttgaggtccagtttttccggtgtaccggctttcatcatcgcatcagcatattcttttgacagaatagaggcgaagtccattgccaggtcagcgaggaacggcgcttccgggcgagtcagcacaaactgaacggtgttgtcgtccacctttttcacttcactgatcagctctggcaagcccatgccttcgaagtattcgtagctgccgccagaaactttatggtacgggttttgcgcgtttttctgacgatcgaacgagaacaccacatcatcggcgttcagttcacgcgtcggtttgaattctttattgtcgtgccacttcacacctttacgcagatggaaggtataggttttaccgtcttcgctgacttcccacttttcagcgaggcccgggatcacttcggtggtgccgattttaaattcaaccagacggttataaagcgggacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacacacaaagattaaaaaaacttcaaacagctatttgcagcagagaaatttgtgctactccaacatgaccagaacaatcagcttaatatttagcaacatttggtgattaagttttatgcatttaatgaaaaaaatctgaggaaaaggtggatatctgagcgattaataccatgaacgctaaaacgcacagcggaaaatgccagggccagccataagtaacgcaaaaaaagatttaagcaaatataaaaaaagacaatggtttctgtcacaaatccgttaatggatagtgagatatggggcgcaaatttggcagggaaatgtgtgtcgtgtaggtcgaataaggcggtcgcgccgcatccgacaatggccggcacatttgcctgatgcgacgctgacgcgtcttatcaggcctacgtcgagtcgaacctccctgcccccggaggttctcatcctcatgagctgcagatgcaaaaaagcctgctcgttgagcaggcttttcgaatttggtcggtgatagaggattactcgccacttcgtggctcgccctgcgggccgttgctggcgcaacgttctctcgcttcgctcgagtcgaacctccctgcccccggaggttctcatcctcatgagctgcagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggccgcttagttagccgctgcctcttttgcctgcgggatgtgacaccagttgttgttttcgttaattccaccatccggtgaagtatagccaagacaacccatgatggtatcgtacagctctacgtgacggcgtggcactttcatgtcggcttcttttttcagctgcgcaaacgcctgcgcattggccggattttccagatatttatctgacatccagaccatcatcggtacgcggaactgctccggcggtgccagttcacgcggcgtgccgtgcaggtgctcgcgttcattaattgactcaccgtggtcagctgcgtagaacacaatcgctttcttatcgcgaacctgatcaatcacgctggagataaagtgatccacataggtcaccgagttgtcataggagttgatcatctgcgctttggtacagccgctatcaacaccaatacattccggcttccactgcgcgaagctacgcggataacgctgggtgtagttaaaatgcgaacctttggtatgcagaatgatcagatgcttaccatccgggttgcgccctagcgattgctgcatttcgtctaccagcaacatatcatctaccggcttgccacgattacgtggctccgcaccaatctgctcacgataagcaatgttgtccgccatcgtgttgctgtagaaccacatttcgctctgcatagcgtagaggtcagaactgaatcctaactgcttcagaaccgcgaaaatgttctgttcttttaatgtgcgctgcggattatcttccgcgcccccctgacgtacaaacatgcaacgcagtgagagtttggttgcggtatcacaggagtaaccacggaacgccgccagatttttctcctgggccagtttcggcgtggtattacgctcatagccgaaaatacccatatggtcccaacgcgtggtttcaccgatgataaacacgacataagtgtcatcaacgttttgcggtgcctgataagtgaatttcttcgccggattaagcaatgaattattatcggaagattcatcgacccgcgcccaggcatacagccccaacgcagaaagccagtttgatggcagataagagttcgctacgacaccgccataactcggcaaatcaacgccggtcgccctctccactttcttctgctggatatccagcaaacgaatcggtgcccaaaccataatacccgccagtacgacgaccgccaggctgcgaatacgctgccctggggttcgcagttgtcggagcaaggtgtagcgacagcggttattccagataaggataagaggcaatgcactaacggcgattaaccagagaataaagttcagaccaacaacttcttttgacaggtcgatatcggtggtcatgacggaagcgatgatgccataaccaatgaccacattaaggaaggtcatgtaatagctggcacctgcggaaaagagcaccaccagcgatgccagaatacgccagctgcggcggccaaacagcgaaagaagacgtagtaaaaagaaggtcaccagtacggtggcggccagttcaacaacagcagaaatgcctttccagacggtaaaatcgtgcgcatagctgccgaagcggcggtaaaaaaccgcgccattcataaaaaggccaatatagattgcaagcaaaaagctcagcttctgctgtgtaatcgatttgatgtatctcatgcaaacaaaccctggacaaacaggtgataacaccctgcttagtggcttttcaggcccggcagggaaaaagtgcggaggtagtcagataagtaaaatctacacgcgcgaataagtagaccacagcaaagggaaaaagtgtggggaaagagtgtgcatgaagcacaaatttacaaaaatgcaagtttgaaaagagactttagcgttacaaaaagcagtaaaaagggccagttaattggcccaaattttacgagtcattgtttatacatttcgttgatgcgtttgatgcacacggaagctgaagcccagtagctcgcggctgagcattaaagggagccatgcgcctcacgcaacattttctgctctggctgacgaatcgtcgtagaaagcgccaatgacagaatcagcagggcgaaaatcacgtagaaggtcacatagaagccgccaaacagtgaggcgataatcgaaccacaaatgctaccgataccgaaaccgagataaatcacaccgtagtttttcgccaggttattgaggccaaagaactcactgaccagtgacggaaagacggtaatagtgccgccaaagttaaatgccacgcaggcaatcgctgcaaagaacgtcactgcattcaatggtgcaaacagcagggccgccatacccaccagcgatatcacctgaccaatggtaataacacggatacgggcgattttgtcagacagaatacccagcaccagacgacctgaaaggttggcgatggaaataacagtgactgcattggctgcggaaaccacatcaaggtgtgccagactttgggcgatatctttcgctaccccaatcacgtacaggccgctcatgcaggcggtcaggaacattaccgctaacatccagtactgcggtttacgcatcgactctgccagcgtgtaatctttctccaccacaccattgctggttttcacttcctgttttggtgcgtctttcattaacgttgcgccgaaaacaatcatcaacagcgcaatcgctccccaaatcacaaaggttttttccagaccgaccgtttccagcagctgcgtgtcgataaatttgaaacccaggctacccagaccataagaaccgatagcgaacgcggagatcagacctttacgctccgggaaccacttcacacagttagagagcgtcagcagataacccgcgccatctgccagtcccaccagcacaccggcgcttaaccacagcatcatcaggttgtcagaatgcgctgtcaggaagaagcctaatcccagcaaaatgccggaagccatggtgacgcgtttaacgccaaaacgttcctgtaatttgcccgcaacagaagacgaaattgccagccccagacttaacaagccgaaagagaaagcgacctggcttaccggcgcatccagcttggcggaaagcgcgccattaaacaggctccaggtataaaccgaccccagcgcaaactgggtaatgatagtaccgatgagtgtcagccagcgggtacgctgataatttgaaggtgtcatggcagtattcctgcagtaataaaaaggaaaaatctctgccgacaaccataacgaagtgcactttatgcctggggaaaaacggcatgaaatgccatcagaacggaatgaaatgccttagttcaggaatgaatgacgcgacaattattcaccaaatttattatttggtaagttagcacccactatcgccacaactattgttatttaatggtttcaattgtgactgttacgttaaaatctggcgctaacccccatcgtatacagatagtcgctattattagtggtattttctgcctgagttagcgcggcataggcggcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcggagatcgccaagccgggagtcaacacgccagcctaaggtactcacgctggcatgccataacggatcggtcagcgtggtagtactgtcgccaaactcgttatacatcgaggtggttgtgccatcgtaatgtaatgccgcgaccgggccggttgtaacctgttcatataaaggaaaattccagcccatactcatactgctggtcacatccacaggggtttcttccgccagattgacttccagtcccagcgccctttggctactttgaatacgttgcgacaaaatatcgttgtaatcaggttgatgatcactatcccaggtgtaacgctctgtggaaagtccgggttgcgtatcaacgatatattcttgttgccaggcgtaagctgtgttgagaaaaaaggcactgattaccacgctcgccagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgagtggggcgtgcctgaaactgacagtaaaaaactgttcgaaatgatctgccttgaagggcagcaggctggattatcgtggatcaccgtcctcaaaaaacgcgaaaactatcgcgcctgctttcatcagttcgatccggtgaaggtcgcagcaatgcaggaagaggatgtcgaaagactggtacaggacgccgggattatccgccatcgagggaaaattcaggcaattattggtaatgcgcgggcgtacctgcaaatggaacagaacggcgaaccgtttgtcgactttgtctggtcgtttgtaaatcatcagccacaggtgacacaagccacaacgttgagcgaaattcccacatctacgtccgcctccgacgccctatctaaggcactgaaaaaacgtggttttaagtttgtcggcaccacaatctgttactcctttatgcaggcatgtgggctggtgaatgatcatgtggttggctgctgttgctatccgggaaataaaccatgattcgggaagcgcaacgttcagaactccccgcgatcctcgaactgtggctggaaagtacaacctgggggcatccctttataaaagcgaattactggcgtgactgcattccgctggtgcgggatgcctatcttgccaacgcgcaaaactgggtctgggaagaagacggtaagcttctcggttttgtcagcattatggaaggccgatttctggcagcgatgtttgtcgcaccgaaggccgtcaggcgcggtattggtaaggcgctgatgcagtatgtgcagcagcgccatccccacctgatgctggaggtttatcaaaaaaatcaaccggcgataaatttttaccaggcacagggttttcacattgtcgattgcgcatggcaggatgaaacccaactacccacatggattatgagctggccggtggttcaaacgctgtaagtgtcagttccggaccgttgtatttttccagccatgccagcgccgtattacccgcacagccattccccagccgcgagctggggagatctttggtcagcacgttcactgcgccgtttttacaaataccgtcagcggttaaatccagatccggccatgccccttcgtgaatgcaaatcacgccaggtttaattccctcgctaatgaccgctccggcaagaatttgcccgcgtgcgttccacaaccgaacagtatcgccatcttgtatgccgcgctcctgggcatcgtcaggatgaatggtgacaggctcacgatttgccaccgcgtacaattcgcgcagagaactgtaattcagctggctgtgcaggcggtgcgccggatgggcagaaagtacctgcaactgttctggttcggcattgccctgccattcgtccggctccagccacattggatgcccagggcaatccgggtaaccgtaatcggcaatacgctgtgagaagatttcaatcttgccgctggcggtttttaacggatgcgccagcggatcgcggcaaaaatcagcgaagcgaataaaccgctcgctgtccgggttttccggcatctcaattaactggttggcttgccagaactcagcaaatggcggcaattcaacctgctggcttgccccgcgctgtcgggcaacgttataaaacgtttccagccattgcagctcactttttccttccgtaaaacgtgcataaccgcccttctcccagcgttcacttaactcggcaaaaacatcaaaatcattacgcgcttcatagcgtggcggcaccacttgcttcatcggcaccagatgctgattactgtaatcaccggtcatggtgagatcattacgctcaaaagaggtagtcgcaggcagaacgatatccgcgtgttttgccgccgccgtccagaagcattcagagatcaccaccagctccggtttttgccaggcacggatcaggcgattggtatcctgatgatgagtaaagttggcaccgcccgcccaccagataaaacgaatatccgggaaatgtcggttcataccgttgtgttgatatgcgccaccagggttttccagtgcttcaacaatgcgggcaacagggattttatccaccgcatcgcagccacccggcaagctgccctgcatggaagagagcaccgcagaacgccgcgtggggttaccaccattggcaaaatggtaagaaagaccaaaaccgccgccgggtgtgccgatttgccccaacattgctgccagcgtgacgatcatccagtgtttttgctcaccaaactgttggcgctgcattccccagcctgccatcagcatggtggtattttggtggaaaatagccgccagctcgcggattttcgctgcgccaacaccacaaatctctgctgcccattcggcggttttcgctattccgtcactctcgcccagcaaataagaggcgaagacggcataacctgtggtgcaacgcgccagaaacgcttcgtcgtgccaaccattttccaccagcgtatgggcgatccccagcatcagcgcaacatcggtgcccatgtgcggtgccacccactccattttatcgccaaagaaatcgacggtttccgatcgcattggatcaatgcagatcagctttttcccgctgtcacgcagtgcagaaaagtaagaaagcccctgctcatcggatgcattccacgcaattttcagcgtattgagtgggttagcactccacagcaccacgacatcgctatgttccagcaccagcggccaactggtctgctgttgataaacttcactaccacccacgacatacggcatgatcgcctgtgccgcgccggtcgaataatcccccagatgcccggtataaccgcctgccagcgccatatagcgttgtaataatgtcgaggccttatgcagcacgccgtttgaacgccagccgtaggaaccagcaaaaatcgatgccggaccataagcctcacgaatgcgtttatgttgttggtgaataagatccagcgcctcatcccaactcacgcgaacaaattcatcctgcccacgaatgccttgcgggttttccggtgacgcaagaaagccttttcgcaccattggaaatcgtacccgcgtattgctgtgaacctggtcgcgaaccgcgctctgcaaggagttttccattcctgtggctaacgcgccacgcgagctaaacacggtttcgccgtcggtttcaaccagcatgggcccccaatgggcggcagtcagaacggaatatcgtgaggatgagttggccaaaccgaagactcctgaaaggttagatgtattgagcagttaaatattacttacaaatttccgagtattcccaggaataatcttcatgttcacgcggcataatctcccgccacggaacccgtggcaaagaataaaaaggttattaaggattaacaatgaagaaacgtgtttatcttattgccgccgtagtgagtggcgctctggcggtatctggctgcacaactaacccttacaccggcgaacgcgaagcaggtaaatctgctatcggcgcaggtctgggctctctcgtgggcgcgggtattggtgcgctctcttcttcgaagaaagatcgcggtaaaggcgcgctgattggcgcagcagcaggcgcagctctgggcggcggcgttggttattacatggatgtgcaggaagcgaagctgcgcgacaaaatgcgcggcactggtgttagcgtaacccgcagcggggataacattatcctcaatatgccgaacaatgtgaccttcgacagcagcagcgcgaccctgaaaccggcgggcgctaacaccctgaccggcgtggcaatggtactgaaagagtatccgaaaacggcggttaacgtgattggttataccgacagcacgggtggtcacgacctgaacatgcgtctctcccagcaacgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccgctgtaatccctttcatgccaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagagcatttcaccgttcaccaggtggcaaacctcagcccacaaaccgtcgaacaaaatgcagcaatttttgccgaagctgaaggtttactgggttcaaacgagaatgtaaatgccgcattgctggaaaaaatgccgaaactgcgtgccacatcaacgatctccgtcggctatgacaattttgatgtcgatgcgcttaccgcccgaaaaattctgctgatgcacacgccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgccgccaccataaagaagcagaagaacgcttcaacgcccgctactgcgatttggatactctgttacaagagtcagatttcgtttgcctgatcctgccgttaactgatgagacgcatcatctgtttggcgcagaacaattcgccaaaatgaaatcctccgccattttcattaatgccggacgtggcccggtggttgacgaaaatgcactgatcgcagcattgcagaaaggcgaaattcacgctgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgagaagaactgtgtgaatccgcacgtcgcggactaagccgcgactgcgtagagtaaagcccgataatcgctcgggcttttactctttattgggttgcagtaactgctgtagtccaggcctgattaaacgcctgatgctgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaaatcatcgctctgttttagcgcagagtgcgcagcatcggcctgcaacttcgcattttgcagttgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtctgacgtgacaaggatagtccaggacaggcttgcaggataccctttctacgtaatcttcctggtaaaatcatggagaaaatgaaacaaggttaatttgttgtttcattgttaaaaaatgatagtgccgttgccttttttgtagccagagatttacgccttcgcagaaggttagattttcgaaatctttacaaaacaggagtggtaagagatatatcggcatttatcagatcgttaggtggctataagtcacgctaaatgacaggctgaatcgaatcatagccagagcatgccctgacttcaccccgctgtgtctgcttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgatttcgcccgggttttgggcgtatcagtcgccatggtaaaggaatgggaatccagacgcgtgaagccttcaagtgccgaactaaaattgatgcgtttgattcaagccaacccggcattaagtaagcagttgatggaatagacttttatccactttattgctgtttacggtcctgatgacaggaccgttttccaaccgattaatcataaatatgaaaaataattgttgcatcacccgccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacacttaattattaaaggtaatacactatgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgttttcaggaaataaataatcgatcgcgtaataaaatctattattatttttgtgaagaataaatttgggtgcaatgagaatgcgcaacgccgtaagtaaggcgggaataatttcccgccgaagactcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagcctcctgtgttgatttccaacgagtatgtactgcacccattttgttggacgatgaaatggaatagcccctaatatgtcaaagccaaaatacccttttgaaaagcgccttgaagtcgtgaatcactacttcacaactgatgatggttacaggatcatctcggcacgttttggtgtcccccgaacccaggtcaggacatgggttgccctctatgaaaaacatggagaaaaaggtttaattcccaaacctaaaggcgttagtgctgatccagagttgcgtattaaggtcgtgaaagctgtgatcgagcagcacatgtcccttaatcaggctgctgctcactttatgcttgctggtagtggttctgtagccaggtggctgaaggtctatgaagagcgcggagaagctggtttacgcgcgctcaagattggcaccaaaagaaacattgcaatatcagttgatccagaaaaagcggcatcagcattggagctgtcaaaagaccgacgcattgaggatcttgaaaggcaagttcgatttcttgaaacgcggcttatgtatctaaaaaagctgaaagccttagctcatcccacgaaaaagtgaaagtactcaacgagctaaggcagttttatcctcttgatgagcttctcagggctgcggagataccgcgcagtacgttttattatcatctaaaggctctcagcaagcctgacaagtatgcggacgttaaaaagcgtattagtgagatttatcacgagaatagaggccgatacggataccgtagggtaacgctgtctcttcatcgagaagggaaacagattaaccataaagctgttcagcgcctgatgggaaccctctcacttaaagcagcgattaaggtcaagcgataccgctcttacagaggagaggtagggcaaaccgcccctaatgttctccaaagagatttcaaggctacgcggccaaacgagaagtgggttaccgatgttactgaatttgcagtcaatgggcgcaagctgtatttgtctccagtaatagatctcttcaacaacgaagttatttcttacagcctttcggaaagaccagtgatgaacatggttgagaatatgctcgatcaggcattcaaaaagcttaatcctcacgagcatcctgttctgcactctgaccagggatggcagtatcgtatgagaagatatcaaaatatccttaaagaacatggtattaaacaaagcatgtccagaaaaggcaattgtctggataatgctgtggtggagtgtttctttggaaccttaaagtcggagtgtttttatcttgatgagttcagtaatataagcgaactgaaggatgctgttacggaatatattgaatactacaacagcagaagaattagcctgaaattaaaaggtctgactccaattgaatatcggaatcagacctatatgcctcgtgtttaactgtccaactttttggggtcagtacaaactttgatttatagtcaggtggggcttttctctgtctgcctttcggtgaatacctgagacaaacagtctcaagcacccgtggctattctagcttaataagtttgtttcttctccttgatataatcctaaaaaaatctcataaaattaatatatgagataatctttattcagcagaagattattaaaggttgctgtattatttagcgataaaaaaagcctgccagatggcaggctatttaataacggcgttattattgcaacagcgaaatatccgcaacgcgcaggaacagttcgcgcagtttctccagcatggtcagacggttgatacgcaattctttgtcatcaaccatgaccatcactttatcgaagaaagcatcaaccggttcacgcagctcagccagttcgaccagcgcatcctggtaacgaccttccgtaaagtacggctccagcttgtcacgtagcaccacaacctgcatcgccagtttaatttcttccggctctttcagggtagaggcattcacgcggtcgctcagcacttcgtcagatttcgccagaatgttagatacacgtttgttcgccgccgccagtgcagcagctgcatccagggtacggaaatgcgataccgctttcatacgggcatcgaaatcagccggacgagtcggacgacgcgccagtaccgcctggatggtgtcaacggtataaccttcgtcctgataccaggcgcggaagcgaccgagcataaagtcgataacatcatcaactacgttggcattagtcagcttatcgccatacagacgcaccgcttcttcggtcagcgtttgcagatcaaggttgaggttcttctcaacgataattcgcagcacgccaagcgcggcacgacgcagcgcaaacgggtctttgtcgcctttcggatgctgaccgataccgaagatacccgccagggtatccatcttgtcagcaatcgccagcgcacaagctactgggttggacggcaggtcatcaccagcaaaacgcggctgatactgctcattcagcgccaccgcgacatcttccgcttcgccatcgtgacgcgcatagtgcatccccataacgccctgggtgtcggtgaactcgaagaccatgttggtcatcaggtcgcacttagacagcagacccgcacgggtagcgtggttaacgtcagcgccaatctgttcagcaatccagccagccagcgcctggatgcggtcagttttgtcgcgcagcgtccccaactgttgctggaacaacacggtttgcaggcgcggcaggttatcttcaagacgttttttacggtcggtgttgaagaagaactcggcatccgccagacgcggacgaacgactttctcgttaccggagataatctgctgcggatctttcgattcgatgttggcaacgaagataaagttcggcagcagtttgccgtcgttcgcatacaccgggaagtatttctggtcacctttcatggtgtaaaccagcgcttcagccggcaccgcgaggaatttctcttcgaattttgcggtcagaacgaccggccactccaccagcgaagccacttcttccagcaggctttcgcttaagtcagcgttaccgccaatcttacgcgctgcttcttcggcatcggctttaatcttcgccttacgttcttcgtaatcggcgatgactttcccacgctcacgcagaatttccggatactgatcggcgttatcgatggtgaattccggctcgcccataaagcggtggccgcgaatcacgcgatcggactgaatgcccagaatggttgccggaatgactttgtcgcccagcagcagggtcacggtgtgcaccggacgcacgaagtgcacgtcgcttgcgccccaacgcatcagtttcgggatcggcagtttcgccagagaagtcgcaaccatattcggcagcagtgcttcggtgctttcgcccttcacatgggcgcgatacagcagccattcgcctttatcggtagtcagacgctcagcctggtcaacggtaataccgcaaccacgcgcccaaccttctgccgctttgctcggtttgccttcagcgtcgaacgcctgggcaatcgccgggccgcgtttttcgatttcacgatccggttgcgcttccgccaggttagctactttcagcgccagacgacgcggagcagcaaaccattgaacggtgccgtgtgcgaggccagcgttatccagctccgcagtaaagttcgcagcaaaggactcagccaggctgcgcagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatgtagcgctgacgctcggtgacggagatggctttacgcgcatccagcaggttgaagctgtgggcggctttcagaatacgctcgtaggctggcagcggcagcggattttccagcgccagcagctgctgcgcttctttctcgtactgctcgaagcaggtgaacaggaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatggccagacgttccagaccgtaggtgatctcgccggtaaccggtttacactccagaccaccaacctgctggaagtaagtgaactgcgtcacttccatgccgttcagccacacttcccagcccagtccccaggcacccagcgtcgggttttcccagttatcttccacgaaacggatgtcgtgaatagtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagctcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatccgcgtcaaaagaacagacaaactgctctttacggaaggtataaccgcgcatttcatagcttccctggaactgttcgaaggcggtgacgtcgattttttgctcgccggtgttataacgttttgccgcctgatccttgcataacgcttccatattcaacgaacgcagaggatcaacctttacccgttgtgctttctgcacgggtgacggtatagaacaacccactagcaccataagcgccattgccggaaagaaagcgttcatcatcattaaattaccgtctggtttgcaggtgagtcttattatttatatcggtatagtggctgatatcttacgaatttccttaagcctctataagctgtagtgataaaactcagattattccagtgcgccaaccaaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccgtcacatgggatatcgccaatgttctgaattctgcctctcgtgtcagcgtgccgctatttttcatgatttccggctatctcttttttggcgaacgcagcgcccagccgcgccatttcttgcgtatcggcttatgtctgattttttatagcgcaatcgcactgctctacattgcgctgtttacctccatcaatatggagttagcgctgaaaaacctgctgcaaaagccagtgttttaccacttgtggtttttcttcgcgattgcggtgatttatctggtttcaccgctgattcaggtgaagaacgtcggcggaaaaatgttgctggtgctaatggcggtgattggcattatcgctaacccaaacacagtgccgcagaaaattgacggttttgaatggctgccaattaacttatatatcaatggcgatactttttactacattctgtatggcatgttgggccgcgctatagggatgatggacacacagcataaagcactgtcgtgggtgagcgccgcgctgtttgcgacgggggtttttattatctctcgcgggacattatatgaattgcagtggcgcggaaattttgccgatacctggtatctttactgtgggccgatggtttttatctgcgcaatcgcgctattgactctggttaaaaacacgctggatacgcgtaccattcgcggacttggcttaatctcccgccattcattgggtatatacggattccacgccttgattatccatgcgctgcgcacccggggaattgagcttaaaaattggccaatactggatattatttggatcttttgcgcgacgttggcagcgagtttgttactttctatgctggtacaacgaatcgacagaaacagattagtgagttaagtaaaagcccggtcacattggactgaccgggcttacgtgagttattcgctgtattcttcctgggtaacctgtgtttcttttggtgggtttattccggcatcacgaatatttttctgcaccgctactgcaccaaacaagcttaagaagaaagccagtccataaaaacctttttcgctgagtaataatgtcgcattccacagacctaccatcagtaatgcaacagagataataaagacagtcaggcaggtcatataataaatggaagtggtcggtatgccttcatacttgtcccgaacggtcttttgataagacgccgcagaaaacagtcctaataccagtacggcaaaataatatcctttttcatttaactgcatctctgcattccatagccctaacagataggtaacgataccaccaacgagagctatccatgacacaatactaaaggccggtgaataggttgatattttgttgtccatcacagtattcctttcattcctgaatatgtaagagctttatgttgctcatgccgagcgaaacaaacgcatttgaccaaacaagcagacaaaaaaggcgatgggatagatcaccatttcataagtattgataggtgcgtttaaaacaccgataaacaagagaccgatagtgattaacgcaactaactggcagatatgggtaaaaaaatcatccagttgcccgagtttttctgcgcgaagatatgcatagttgccaaaagttgctgtcattaacacgccaagaaaatagccttttccacttaacaatgggcatgagatccatagcccaaccagataaaccagcgccccgacaacaaataatagttttgccacagtctttgaggttttcataacgatctccatatctaccagcgatacattacgagtaaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaacggtagttgcggcaacaattcaatgagcgatttctctggattcgccgcgatctgcgccagccttgctgcgcccagtgctggccccacatccccccccgtacggtaatcgagctgctgaccgctgatatccgccagcatctgacgccagtactcactacgcgccccgcccccaatcaacgtaacactttgcggtttaataccgcaggcatgcacgacatccatgccatctgccagcgcataacccacgccttccagcactgctcgcgccagttcattggggccatgttgatgagtcaaaccaaagaaaacccccttcgcctggggattattgtgtggcgtacgctcgccggaaagataaggcagaaaccaaactggctcggcactttcatcagcctgttgagctgcagcgattaaagctgggacattgctcaggccggttaatttcgcggcccaatccagacacgacgctgcactcagcatcacagacattaaatgccaacgttgcggtagcgcatggcaaaagctatgtacggcgctttctggcttgcttaagaacccttcgctgacagcaaaatagacccccgacgtccccagcgataacattgcctgattagcatcaaccattcccacaccaactgcaccagctgcattgtcgccaccgcctgcgacaactggcaccgtcgccataccccacgctttcgcaacttcaggtaacaaagcaccagtaatttcgctgccttcgtataatgcgggcatctggtcacgagataagtcgcaagcctgcagcatgacgtcactccagtcacgctttgcgacatccagccacatggtgccagctgcgtcagacatatcgctggcaaactcccccgtcatacgcagacgcaagtaatctttcggtaataatactttgtcgatttgacggaatatctccggctcatgccgctgaacccatagcaatttaggcgcagtaaatccgggcatcatcaggttgccggtaatcacccgcgattgcggaactcgcgcttccagcaaagtgcactcttgcgcacagcgcccgtcgttccacaaaatggcagggcgtaacacccgttgctgagcatccagcaaggttgctccgtgcatctggccggcaatacccaatgctttaacgtcctgcagagaatgctgatcgcccagagctttcattgcgcgatcagttgcctgccaccactgttccgggtcttgttccgaccagagtggatgcgggcgcgaaacggtcagcttttccgtttgcgcagcaaccacctcaccctgctcgttgagcaaaataacttttacgcccgaggtgccaagatctatcccgatatacatatcgatcgttccttaaaaaaatgcccggtatcgctaccgataaccgggccaacggactgcacagttagccgttatttgtcgaacagataatggtttaccagattttccagttgttcctggcgaccactctgatgcaccggagacaaatgatgttcctgagcatatttggctaaatctgccagtgacatttggcctttcaggatttgctggcccaattcgctattccagccggaataacgctgcgcgatgcgtttatccagctcgccatcttcaatcatgcgcgctgcaattttcagcgccagtgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcggcatcgtaatcatattgatgtttggtcggttcttgcggtttcggttcgataagcaacgtgccctggaaaccgattttatgtttatgctcaaccaccatctgcataaagcggcccagttgttcacgctcctgacgcaagtcggtatttaacagcgtttcgtaaccttcacgaccgccccacaggacatagttttcaccgcccaatttatgggttgcttccatcgctgtaacaacttgcgttgccgcccagctgaagacttcaggatctgggttcgtcgccgcacccgcgccgtagcgagggtttgtaaagcagttggccgttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatccgccccgttccagcagaaggtgtgccagtagcaggcggcaaaacgcaagtgctcttccatacgcttacccaacaccagttcgtcgggattgtagtgacggaatgctaacgggtttgaggattttgagccttcataacgaacgcgatcgagctggtcaaaataggcttgcatattgaactccataatcaggtaatgccgcgggtgatggatgatgtcgtaatattgggcactccctttcagttgctcaattatgttatttcacactgctattgagataattcacaagtgtgcgctcgctcgcaaaataaaatggaatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaaactgtcctctaactacagaaggccctacaccatgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgagttgggcaatggtcaggaaccaaaagcagataccacactgaataatggcctgaaagatgtcccctcccgcctcctgacaccgatcgatgtgaataaaaacaacatcaaagatacggtaattaaagacggattccacaaagagagcgagctgtaagcgttacgccccagcgcggagcgggggcgtgatttctctccatgccgcgtgaatgaattggcttaggtggagtcgttatgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcgattttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatattgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctgttaggtggcgtcgcggcgatttgtgacgtctggttaggctggcctttgccacttaccatcattgtgacgctggttctgggactgcttctcggtgcctggaacggatggtgggtcgcgtaccgtaaagtcccttcatttattgtcaccctcgcgggcatgttggcatttcgcggcatactcattggcatcaccaacggcacgactgtatcccccaccagcgccgcgatgtcacaaattgggcaaagctatctccccgccagtaccggcttcatcattggcgcgcttggcttaatggcttttgttggttggcaatggcgcggaagaatgcgccgtcaggctttgggtttacagtctccggcctctaccgcagtagtcggtcgccaggctttaaccgctatcatcgtattaggcgcaatctggctgttgaatgattaccgtggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttgattttgataaaaattttctcaaagccggttacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacagatcgagcaagcgctggctgatgtcgacgtccccattgttggggttggcggctcgtatcaccttgcagaaagttacccacccgttcattacattgccaccgataactatgcgctggttgaaagcgcatttttgcatttaaaagagaaaggcgttaaccgctttgctttttatggtcttccggaatcaagcggcaaacgttgggccactgagcgcgaatatgcatttcgtcagcttgtcgccgaagaaaagtatcgcggagtggtttatcaggggttagaaaccgcgccagagaactggcaacacgcgcaaaatcggctggcagactggctacaaacgctaccaccgcaaaccgggattattgccgttactgacgcccgagcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgattattagataaagaagaaatgccgctacagcgaattttggtcccaccagttcgcgtcattgaacggcgctcaacagattatcgctcgctgaccgatcccgccgttattcaggccatgcattacattcgtaatcacgcctgtaaagggattaaagtggatcaggtactggatgcggtcgggatctcgcgctccaatcttgagaagcgttttaaagaagaggtgggtgaaaccatccatgccatgattcatgccgagaagctggagaaagcgcgcagtctgctgatttcaaccaccttgtcgatcaatgagatatcgcaaatgtgcggttatccatcgctgcaatatttctactctgtttttaaaaaagcatatgacacgacgccaaaagagtatcgcgatgtaaatagcgaggtcatgttgtagcgatgatgagaattgtcggcgtcacatcaggtaacgctgcgtggttgtcggatgcggcgtgaacgccttatccgacctacccgccaggcatgataaaacgcaccaacaacgcttcaggctcgtagctcaactgcctgagacaaagtaaaaagccttatccgactgacaagtcggataaggctcaaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgcgcacgcgatttacggaacgaagagtaagccgggtgcgtattcaggttagtgacataggcgctcaccgattctttgacagaactaaactgtgagtaccctttcactttacctggcgcattggtacaacgtcctttcatgcatttcatgccgaacaggttgttgttgttgcgcgccagcttcgacgttccccaaccgctttctgctgcagccatcgtcgccaccatactggtggggataatgtctacgcgttcaagcaaggtattccacgggatttttcgcgtattaccggaccacttcaccttgtagcgtttggcgatgtctttcagacgcgcacgctcagcaggtgaccattggccctgatactgttttgaaatgagccagttacgttccgcagtaatggccgcattttggctggtaatgtaaggcattacggtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatatttttcacaaatttgagagttgaatctcaaatcatatcaaaaatagctgtcaagagcaccccaaggaatagtccaaatctgaaactatgtcacgtgttaacgattcagattggcgctaaatcgcagaaaatgtgggggttatcgcaaaattcagccgttttttgcgcgagatcgctcacccttgcttctcatcctgtggacttaccgctcagggatgagttttgtttggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagccgccaaccaggataaaatgtcagccctaatcagcgttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccaagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaaaaattgcctgatgcgctacgcttatcaggcctacatgatttctgcaatatattgaatttggaagaatttgtaggccggataaggcgtttacgccgcatctggcataaacaaagcgcactgttccggcgttgagaaacgccggaaaacgtttcaaacaggctgctgccgtagccgatgccgctgcactttctcgacatccatgcactgcaacgcctttgtcgggcaggcttcaacacaggccggtcccgtctcccgatgccagcacagatcgcacttaatcgccctcgcctttttgcgcgaagaaacgacctccatcgcaccaaacgggcaagccagcatacagcttttacagccaatgcaacgtgtttgttcaacgaaaatatgcccatgttcgcggcttatcgcgtcaacagggcagacattcgcgcacggtgcatcttcacactgatgacaggctactgccgtggtccagcagtggtctttaatgacacgaatacgggaaataaactcgtctggtgacaacgcagcgcaatcctgattctcatgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagcgttatgtgatcgcgcccaggtcatccctgacagtaaatcccagttcattagaaatagcctgcgcggtttcacgcagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccgctttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggccaatataggcacgggttcgcagcatcccggttgtgggttccagcttataaatcaaaatagcgtgatcgtcttcgcggctggagaagttaatggtttcaccagtggcgatgttcagtgcctcaagatgcggagcggcgatatgaatgatattcagcgaagacagcgccttctgcccgacggcaataaatttggtggtcaggcgataactccctgcggcaggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccgcgaaacagactctggcttccggctggacgctctttttcctgcgccatctcgttctctttttttcccatcacttctttccccattttgtcgcgtcctgatggtagcgcaaagtgtgccgtagttcacgatctcgacagataatttataaccaattgatttttatgtcttttgaaattcatcaatcagattgccttgttaaaaagtgatcgatatatttgaaatcaagtttcgcatattgaaattttaagccaaaaaagcgatcaaaaaaacaaggaagcctgggatgaaagtgacatttgagcagttaaaagcagcctttaatcgggtcttaatttcacgcggcgttgacagcgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccgccgtggggcgcaaaagagtgtcgcataggcactaacccgctgatcgtcgccattccttccacgccgatcaccatggtcgatatgtcgatgtcgatgttctcttacggcatgttagaagttaaccgtctggcaggtcgtcagctcccggtcgatggtggctttgatgatgagggcaatttgaccaaagaacctggcgttatcgagaagaatcgccgcattttgccgatgggctactggaaaggttctggcatgtcgattgtgctggatatgatcgctactctcctttccgacggcgcatccgttgccgaagtcacccaggacaacagcgacgaatacggcatttcacaaatttttattgccattgaagtggacaagcttatcgacggtcccacccgcgatgccaagctgcaacgcatcatggattacgttactagtgccgagcgtgctgacgaaaatcaggccattcgcttacccggccatgaatttactaccctgctggccgaaaaccgccgtaacggcatcactgttgatgacagcgtgtgggccaaaatccaggcgttatgaggagataagtcatgatttttggacatatcgcgcagcccaatccgtgccgtttgcccgccgccattgaaaaggcgctcgattttctgcgcgctaccgatttcaacgccctggagccgggcgttgtcgaaatcgacggcaaaaatatttatacgcaaattatcgatttaaccacacgcgaagcggtggtaaaccgtccggaagtgcatcgtcggtatatcgatattcagtttctggcgtggggcgaagagaaaatcggcattgctattgatacgggaaataataaagtcagcgaatcactattagagcagcgcaatattattttttatcacgacagtgaacatgaatcatttatagaaatgataccgggcagctacgcaattttctttccgcaggatgttcaccgaccaggttgtattatgcaaacagcctctgagatacgaaaaattgtggttaaagtcgcattaacggcgctgaattaatcgaataatcgtctacgccagaacgcctgggtaatgttattgctctaactatattaataattcaggttgctgcacatgcgacttgaattatgacagacatagcctcaaggaatagctatgaaaaaaatactcgaagcaatactggcgattaatctcgccgtactttcctgtattgtatttataaacattattttaagatatggttttcagacaagcattttatctgttgatgaattgtcacgttatttatttgtctggttaacgtttattggcgcgattgtagcttttatggataacgcccacgttcaggtcacctttctggtggagaaactctcccccgcatggcagcgacgagtcgctctggttacccattccttaatcttatttatttgtggcgcactggcctggggcgcaacgctaaaaacaattcaggactggagcgattattcaccgatcctcggtttacccatcggcctgatgtatgccgcttgtctgcccaccagcctcgttatcgcattctttgaactgcgtcatttatatcaactcatcacgcgtagcaattctctaacgtcgccaccgcaaggagcttaatcatggctgtgctgatttttctgggctgtctgttgggtggtattgctatcggtttgcctattgcctgggcactgttgttgtgcggggcggcgttaatgttctggctggacatgtttgatgtccagatcatggcacaaacgctggtgaacggagccgatagcttctccctgctggcgattccgttctttgtgctggcgggtgaaatcatgaatgcgggcggcttgtcaaaacgcattgttgacctgccgatgaaactggtggggcataaaccaggcgggctgggctacgtcggcgtgctggcagctatgattatggcgagcctttctggttctgccgttgcggataccgccgccgttgccgctctactggtgccgatgatgcgcagcgccaactatccggtcaaccgggcggcggggctgattgcctctggcggcattatcgcgccaattattcccccttccattccgtttattatcttcggcgtttccagcggattatccatcagtaagctgtttatggcgggcattgcccctggcatgatgatgggcgcaacgctgatgcttacctggtggtggcaggccagtcgccttaatttaccccgccagcaaaaagcaacgatgcaggaaatctggcactcttttgtctccggtatctgggcgctgtttcttccagtcatcattattggcgggtttcgctccggcctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctgattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatgatgcagtcagaggcgttttcccttacgtcctggttttatattcattattagtcgtatttgtttttattcccgatctcatcatcctccctttgaaatggattaattaaaaggaaaatattatgaaattacgctctgtaacctacgcattattcattgctggcctggctgcattcagcacatcttctctggcggcacaatctttacgtttcggttatgaaacatcacaaaccgactcgcaacatattgcggcgaaaaaattcaatgatttattgcaggagagaaccaaaggcgagctgaaattaaaactgttcccggacagcactctcggtaacgcgcaggcgatgatcagcggcgtacgtggcggcaccatcgatatggaaatgtccggctcgaataactttgccgggttatcaccagtgatgaacttgcttgatgtccctttcctgttccgcgataccgctcacgcgcataaaacgctcgacggcaaagtcggtgatgatctgaaagcctcacttgaaggtaaaggactgaaagtactggcctactgggaaaacggctggcgcgatgtcaccaactcgcgcgcaccggttaaaacccccgccgacctgaaagggctgaaaatccgcaccaacaatagcccgatgaatatcgccgcattcaaagtctttggcgctaacccgatcccgatgccgtttgccgaagtctataccgggctggaaacccgcactatcgacgctcaggaacacccgatcaacgtcgtctggtcagcaaaatttttcgaagtgcagaagttcctttctctgacgcaccacgcctattccccgcttctggtggtgatcaacaaagcgaagtttgatggcttaagtccggagttccagcaggcgctagtttcatctgcacaagaagcgggtaactatcagcgcaaactggttgctgaagatcagcaaaaaatcatcgacggcatgaaagaagcgggcgtggaagtcatcaccgatctcgaccgcaaagcctttagcgacgcactggggaatcaggttcgcgacatgtttgttaaagatgtgccgcagggagctgatctgctgaaagccgtggatgaggtgcaataaaccatgacgcaatactggctggggttagattgtggcggtagctggctgaaagccgggctgtatgaccgcgaaggccgggaggcaggcgtgcagcgcctgccgctgtgcgcattaagcccgcagccaggctgggcagagcgcgatatggcagaactgtggcaatgctgcatggctgtcattcgcgccctgcttactcattctggtgttagcggggaacaaattgtcggtatcggcatctccgcacagggaaagggcttgtttttgctggataaaaacgacaaaccgctcgggaatgctattttgtcctcggaccgccgggcgatggaaatcgttcgtcgctggcaggaagatggcatcccggaaaaactctacccgctgacccgacaaaccttgtggaccgggcatccggtgtcgctgttacgctggctgaaagagcacgaaccagaacgctacgcgcaaattggctgcgtgatgatgacgcacgactacctgcgctggtgtttaactggcgtcaaaggctgtgaagagagcaatatttccgagtccaacctctacaacatgagtcttggggaatatgacccgtgcctcaccgactggctggggatcgctgaaatcaatcacgccctgccgcctgttgtcggatctgccgaaatctgcggggagatcaccgctcagacagccgccctgaccggtctgaaagcgggtacgcccgttgttggcggcctgtttgatgtggtttccaccgcactctgcgccgggatcgaagacgaatttaccctcaatgcggtgatggggacctgggcggtgaccagcggcataacccgcggtttacgtgacggtgaagcgcatccgtatgtctatggtcgctacgttaacgatggtgaatttatcgttcacgaagccagccctacctcttccggcaacctcgaatggtttaccgcacagtggggagaaatctcgtttgatgagatcaatcaggccgttgccagcttgccgaaggctgggggcgatctctttttcctgccgttcctgtacggcagcaacgccggactcgagatgaccagtggtttctacgggatgcaggccattcacacccgcgcgcacctgttgcaggccatctatgaaggggtggtgttcagccatatgacccacctcaaccgaatgcgcgaacgttttactgatgttcacaccctacgcgtcactggcggcccggcgcactccgatgtctggatgcaaatgctggcggacgtcagcggtctgcgtatcgagctgccgcaggtggaagaaaccggctgctttggtgcggcccttgccgcccgcgtcggcaccggggtttatcacaacttcagcgaagcccaacgtgacttgcgacacccggtgcgcaccctgctgccagatatgaccgcccatcagctttaccaaaaaaaatatcaacgttatcagcatctcattgccgcacttcagggctttcacgcccgcattaaggagcacacattatgagccgaccacttctgcaactggccctcgaccactcatcacttgaagccgcgcagcgcgacgtgacgctgttaaaagacagcgtcgatatcgtcgaagcgggcaccattctctgtttaaacgaagggcttggcgcggtgaaagccttgcgcgaacagtgcccggacaaaatcatcgttgctgactggaaggtcgccgacgctggtgaaacgctcgcgcaacaggcgtttggcgcaggcgctaactggatgaccatcatctgcgccgcgccgctcgcgacggtagaaaaaggccacgcaatggcacaacgctgcgggggtgaaattcagatagagctgttcggtaactggacgctggacgacgcccgcgactggcatcgtattggcgtgcggcaggccatttatcatcgcggtcgtgatgcacaggccagcgggcaacagtggggcgaagccgatctggcacgcatgaaggcgctttcagatatcggccttgagctttccattactggcgggattacccctgctgacctgccgctgtttaaagatatccgcgtgaaagcgtttattgccgggcgggcactggcaggcgcggcaaatccggcgcaagtggctggcgatttccatgcgcaaatcgacgctatctggggaggtgcgcgtgcgtaatcatcagttagggatttatgaaaaagcgctggcgaaagatctctcctggccggagcggctggtgctggcaaaaagctgcggttttgattttgtcgaaatgtcggtggatgaaaccgacgaacggctctcacgtcttgactggagcgccgcacaaaggacttcgctggttgccgcgatgatcgaaacaggtgttgggatcccgtcgatgtgcctgtccgcacatcgtcgctttccctttggtagccgtgacgaggcagtgcgcgaacgggcgcgggaaatcatgagtaaagcgattcgcctggcgcgcgatctcggcattcgcaccatccagctggcaggttatgacgtctattacgaagaccacgacgaaggcacccggcaacgttttgctgaagggctggcgtgggcagtcgaacaggcggcggcatcacaagtaatgctggcggtggagattatggataccgcgtttatgaactccatcagcaaatggaaaaaatgggacgagatgctcgcctcaccgtggttcaccgtctacccggacgtcggcaacctcagcgcctggggcaatgatgttcccgccgaactgaaactgggcattgaccgtatcgccgcgatccacctgaaagacacccagccagtcaccgggcaaagtcccggacagttccgcgacgtgccgtttggcgaaggctgcgtcgatttcgttggcatcttcaaaacgctgcataaactgaactatcgcggttctttcctgattgagatgtggaccgaaaaagccaaagagccggtgctggagattattcaggcgcggcgttggattgaagcgcgtatgcaggaggctggatttatatgttagagcaactgaaagccgacgtgctggcggcgaatctggcgcttcccgctcaccatctggtgacgttcacctggggcaatgtcagcgcggtagacgaaacgcggcaatggatggtaatcaaaccttccggcgtcgagtacgacgtgatgaccgccgacgatatggtggtggttgagatagccagcggtaaggtggtggaaggcagcaaaaaaccctcttccgatacaccaacgcatctggcgctctaccgtcgctatgccgaaattggcggtattgtgcatacccactcgcgccacgccaccatctggtcacaggccgggctggatctccccgcctggggcaccacccacgccgattatttttacggtgccatcccctgcacgcgacagatgaccgcagaggagattaacggcgaatatgaatatcagaccggcgaagtgatcattgaaaccttcgaagaacgtggcaggagtccggcacaaatcccggcggtgctggtgcattctcacggcccgttcgcatggggtaaaaacgccgccgatgccgtgcataacgccgtagtactcgaagaatgcgcctatatgggtctattctcgcgccagcttgcgccgcagctccctgcgatgcaaaacgaactgctggataagcactacctgcgtaagcatggggccaatgcctattacgggcagtaatccctcacgccggggcttcatcgccccggcactacgaattgatatgttccttgctgtaacgccgcttccacgctgctggcgttaaaccagtatgtttctgaaaaatctgccggaaatagccaacgtcattaaaccgtattgcatggagcaggccgacaacgtcgagtcactgcataacctgttgctgcccgccgatgcgccatttacgacatttgaaggcaagggattgttcagccataagatcctgattcagacgccaggttcccggtatgaacagagcaatccagagcaacaacctttgtggcattacgacggagcaccagccgcaccgacatccaccggtgaattaaaaacgccagctcaccccggtgacaaaggtaaaactctcattacgatcaatcatcgggctgtcggtaatctcttccggcagctcgctgtatcctgcgctcgccatcaatacgacgtgctctcctatcgggtattttgccgtcaggctgacatagggcacccaggcatcctgcgcggaataacttgccagaccgctacgacgggactcactctctgaaatgccatagtaatagtcactgaaattctcgtcataatagagaacgcccagcgcaggtgtcagcgacagacgacctatctgcattttgtggaataccgatagctcccccacccagccgttgctgttatccagaacgtccgcagctgcagaggctttcacggttccccaacgctcgtggtgataccaggcaacccccgccatagccgtactatcacgcttatcaagctgttgcatggcataatcgtcattatcggtagggtcaaattccagcggcatccaggatgcggtcaggctaagttcatttttttcactttgcgacagaataaaacctaacgtggtctgacgaacataaaaagtatcaccttcataactaatcagcggaattgccttcgtattttcattataaccgcgataaggcgattcattataagccgcaccagcaccaatggataattcagaagcagttgcgcttgccataaaaggcaacgcaaataacgccacaatattgcgattaattaacatgtccggtattccattttaaaataagataaaaaagagtcggcataataatgcttacaatttctccggtgcaagattcatatttatatagtaatatataaaattatatataattgggctgttgcgatgacaaaattacaacttaagtaccgggagttaaaaattatctcggtaatcgctgccagtgaaaatatcagccatgccgcgactgtacttggcatcgcacaggccaacgtcagcaaatatcttgctgattttgaatcaaaagtgggtttaaaagtctttgaccgaaccacccggcagctgatgctcacaccttttggcaccgcgctgttaccgtacatcaacgacatgctggacagaaacgagcaacttaataattttattgcagattataagcatgagaaacgtggtcgggtcaccatctacgccccaaccggcataattacctatttatccaaacatgtaatcgataaaattaaagatatcggtgatatcaccttatcgctaaaaacctgcaatcttgagcgtaatgccttttatgaaggcgtcgaatttcctgatgattgtgatgttttaatcagctacgctccaccaaaagatgaatcgctggttgccagttttattacccaatatgccgtaaccgcttatgccagccagcgctatcttgagaaacatcccattagccgtcctgacgaactcgaacatcactcctgtattttgatcgactcgatgatgatcgacgacgcgaatatctggcgcttcaacgtcgccgggagtaaagaggtgcgggattatcgcgtgaagggaaattacgtttgcgacaacacgcaatctgcgctggagctggcacgaaatcacctggggattgtgtttgcgccagacaaaagtgtgcagagcgacctgcaagacggcacgctggtgccctgctttcagcaaccctatgaatggtggctggatctggtggctatcttccgtaaacgggaataccagccctggcgggtccagtatgtgctggatgaaatgctgcgtgaaattcgccaccagcttgctcagtcgcagcaactgcggcctgaacaagcggcggaaagcgaagattaatgatcgagataaaggtaatgcacccagctggtcatgcgtaatagcactttgcgcatcaccgagacatggctgaaatgatcagagtaaaccgccacctgggcgtaaataccgtctggtaaagcgctcaaatcagtgtgctcatccagttcaatggtcgcgataacgccatctgaacccggcgctgtgtttaacgtctgtaaggtgccggtcgactgataagctccgccgggaacggctggactaatggctgccagcttaccgctgaataccttacctggcagagcattaaacaccacttccgcatcgtcgccaggagccagtcgcagcaaggagttctgacggaactgcgccacgatttgtcgtttctgatcgggtataaacaccatcaccggacgtagcggcagcgacgcggcataggtacccggacgaatcagtacctgggtcacataaccatcgctcggcgcacgcactatcgtctgctcaaggttatattttgcttccgcgagctgtgctttcaggctggcgatttgagaatgttcacccaacaccaggctatccagctggctctggatctgtttttgttccgccgccgatgacttcacggaggcttcctgcgccagataattttgccgcgccacatcgatatcgcgttctgaaaacgggtttactttcgcctggctgccacgtgcgtaacgctgatactctttagcgaatttatcccgcgtggcctttgcctgctgagtattcgccgccatctcatctaactctgcgcccaacgcccgctgtttatgttctgcggtaacgatatccgccatcagccgatccacccgcgcctgataacgcgtcgggtccagtcgaaatagcacctcaccttttttaatcagcgtatttttcttatccgtcacttcaatcaccacaccagtcacctgtgggacaacaggaatagaaataaccgctttttgcgctttaaaggtatacggatggttatagttcattaacagaattagaccgctgacaataaatattccacccagggccgctgtgggaatggtccatttatttacgggaattttgaagatcttaaacattgcccatgcaaaagccacataggtcaaaataatcagtaaatccataagtattactcggcagaagaggatttgatgtcggcgagctgtttctccagcccggcaatgcgctgttgcagttgcataacggatgaatcatggctttgcattccccatccccgctccgggcggtaaagcgtggcccaaatccacaaaaacggccagataacatgtaacgtaaaaagactcacccaaccagcaacatgaatggcgtcggcatgaggatgattacgttttttggcaatcaggtagggaatatcatgtaaaataatgatcccatagaagatcaccagaaatacaaaaataagcactcccagtgcaaaatagtccaggaacatatttccctcaaagaatataaaaaagaacaattaacgcatattatgaaatgccatgatgcagtgcaatttccttatttatataacgacatattgttttttatatactttcttaaatgtgctgtctggtttttcaacaggacgaggtttatcatattgaaatagtggaactattggccaaactaatgaataactccagtaaaacatccacagtacagattaagcgtattaaaccttcaattatctaccgtttattgctgattggcctcggatcaccaatggtgatttacggcctggttcgcccgctcaccatcgaaacgcgagattaaactcctgacaaaacacgccccagaaacgtacttctgttggcgtagtctgggttattgcgcacgtaggtttaaaacgtaaattgtaacaacgtgcgctttgtttatgccggatgcggcgtgtacgccttatccggcctacggtcaggttcccgtaggcatgataagacgcgtaagcgtcgcatcaggcaatgaatacccaatgcgaccagcttcttatatcagaacagccccaacggtttatccgagtagctcaccagcaggcacttggtttgctggtaatgctccagcatcatcttgtgggtttcgcgaccgatacctgattgtttgtagccaccaaacgccgcatgtgccgggtaagcgtgataacagttggtccacacgcgcccagcctgtatgccgcgccccatcttataggccagattaccgttgcggctccagacgcccgcgcccaggccatattgcgtatcgttcgccagctccagcgcttcttccatcgttttgaaggtggtcaccgccagcaccgggccaaaaatctcctcctggaacacccgcatattgttctgaccaaacagaatcgtcggttcgaggtagtagccgtctttcagttcaccttccagcagcttgcgccgcccgcctgtgagcacgtcagcgccctcttttttaccgatatcaatgtagttgaggatggtttccagttgcccgtgagaaacctgcgcgcccatttgcgtcacgctgtcgagcgggttaccgctacgaatgctttcgacacggcggatggcgcgttccataaagcgttcgtagatagattcctgcactaaagcacgactcggacaggtgcaaacttcgccctggttaaaggcaaacagtgcaaagccttccagcgctttatcgaaaaaggcatcttcttcatccatcacatcagcaaagaagatatttggcgacttaccgcccaactccagcgtcaccggaataatgttttgcgttgcgtattgcataatttgttggcccacttccgttgagccggtaaacgccactttggcgatgcgtttcgaggtcgccagatattcgccaattaccccacctgcgccattgaccacgttcaccacgcccggcggcagtaaatcaccgacaatttccattagcagcagtacagaaagcggggtaagacgtgcgggtttcagcaccacacagttgcccgccgccagcgcgggagccattttccagctcgccatcagcagcgggaagttccacgggataatctgccccaccacgcctaacggttcatggaaatgataggccacggtttcgctatcaacttcactgatcccaccttcctgcgcccgaatacacgaggcgaaatagcggaaatggtcaatcgccagcggtacatccgcagcactggtttcgcgaatgggtttgccgttatcccaggtttcagctgtcgctaacagctcgaggttttgttccattcgatcggcaatcttaaacagaatcgccgcacgatcctgcaccgaggtgtgcgcccatttatctttcactttgtgcgcagcatccagcgccagatcgatgtctcgtttgcccgaagacgccacttcgcacagcagctgcccggtcaccggcgtcagattctggtaatactcgccgtcggcaggggctacccattcgccgccaataaagttgtcatagcgggcttttaacttgagggggaaaccatactcgccgggcttaatctgtgctgaagggggattattggtcatgatcgtctccttgcggtgtgaggtataacaagggtagacgtgactggcgaaatcttcgccagtcggtaacagctttacgacagctatcacgaatttacgggcaagggttacagagatagttgaaaaagcggctaacaatttgccagccgttgtggaaatgatgattacatcgctgcgcgataaatcgccacaatttcttcgtgagttgcctggatcgggttagtaaagccacaggcatctttcagggcattagtcgccaataccgcgaaatcttcttctttcacgttcaggtcgcgtaggcctgccgggatatccactttcttcgccagttcacggatggcgttaatgcaggcttcagcaccttccgcgtcgtttttacctgtcacgttcacgcccattgcagcggcacagtcacgcagacgtgcagcggcgactttgctgttgaatacctgaacgtgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttcgcattactgccatcttcaacggctaacggcaggttttcggcaatcatggtcacggctttcagtgcacaagcgtcagtgatcggcgtggcggcaatagaaacatatgcttcgatagcgtgcgttaaggcatccatacccgttgcggcggtcagtgacttcggcataccaatcatcagagaggagtcattgacagaaagcagcggagtgacatgtttatcaacaatcgccattttgatatgacgcgcttcgtcagtgatgatgcagaaacgggtcatttcagaggccgtacccgccgtggtattgatggcgatcatcggcagctgcggttttgcagagcggtcaacgccttcgtaatcgcgaatatcgccgccattggctgccaccagcgcaataccttttgcgcagtcgtgtggagaaccaccgcctaaggagatcacgctatcgcaattattctctttaagtaatttcaaacctgcggcgacgttttccgtggtggggttaggttgggtgccatcataaataacgctaaaaatattgcgttcttccagtgctttttgcacatcgcccgccatacctaatttcgttaacatattgtcagtgacaattaaggtacgggtaaatccataatctgccatcatattcattgcatcagtcaatgaatcagcgccgatgacattcacagaaggaataaagaacgttgaagctgccataacacactcctgaaagtgtaaaaaagggcgggcagcttactgaggattttcattcgaaaatatgatcagtattattgattatcaaaattaatctaataaaaagcacattgtattcattaaacaatgtgctttttttaaattcataagaattttgtattaatttattttaaaacttaattaatcatttccttatttttccggaaataataatgcgtcgcgcaataaatgatcatttccacgacgacgcgtaaagccaatgcggtcaaaatattccagaatctgaattgccagctttcggcctacgcctaagcgatcgcggaaatccgccgcgcaggttgaaccacactcctgatcgagatcgcggatcatattggcaaactcgacaatccgatcgttacggtaataacgatctttaacgatcgcggtaattattccttgctgcgccgcctggcgtagagtcaggcgcattgcctgctcgtcggttcccgtctcttttgccaggtcacgcacccaccacggttcgtcaccaaacagtggctctgctttttgccagatggcctgctgctcttcgctgaagcccgctttgtgatctggcagatgcagccagccgtgatggctgtggatgtcgccgctttcgcgcatcttttcaatcagcaacagtaccagcgcttcatcttccattggcaacgccatacgtcgcagacgttcgcgcccagggccaggttcatcgcgatgttgctcatgataagtcgctaatgtgtcgagaattttccgctgccagcgggcggcaaccggcgcattcaacaagctataaccagcctgaatataaccaggctgttgcagcaattcgcgcatcccttcgccgttgagctggcgcgcccaggcgaaatccgcaaggttaaccgcgccgcgttccagatgaacagataacgcatcggcatcgctctgcgcccgtgcaagagacgccagccattgcagatattccggcttacgtttaccgcgacgcggcgggttaagcatcacgacgcgcgctccggccagcgtgttgcgggcagagatatcgcgcaataccaggcggtcgttatctgccagccataacggggtgtcgaagaccagttcagcaaggttatcttccagcagtgaaacgcgtcccgtgacgtggctggcggcgtggtgaatatgcagcggctgccactgggtcagcggtgtatgggtttgaagctcgacaatcacccgtgtgaacggctctggcggcacatcggcaagcagccagtcgccacggttaatctgctctttttccgcatcacccgcgatgttaagcgcgatacgctgcccggcattggcggtttctgttggctggttttgcgcatgcagcgcacgtacacgcatcggtttatttacaccagtcagccagagtgaatcgcctaccttcacttccccgcttaacgccgtaccggtgacgaccagcccggcaccttttacggtaaatgcgcggtcaatcgcgaggcggaaactatgttggctggcgtgctcgcgttccggcaactgaagcagatgctcgcgcagggcatccattccccgaccttcggttgctgcggtgataaacagttttgcctcagcaaaaccgtattcccgcagaacctcctttacctggcgttcaacctcatcaacacgcgcttcgtccacgcgatcggctttggtcagcgccactgtcagcatcgggttaccggtcagctgcaaaatcgccagatgctcacgggtctgtgccatcacgccgtcatcgcacgccaccaccaacagcgcgtgatcgataccaccaacgcccgccagcatgttggaaagaaacttttcatgaccgggaacgtcgataaaaccaggcacgcgaccatccggctgcggccagtaggcatagccgagatcgatggtcatgccgcgctttttttcttccggcagacggtcagcatttacgccagtaatcgcctgcaataaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggtgtaaacgttaatgccgcgctcggcaggcgatcaaccggcagcgaaccactgccaatctgcgaaagacatggcataacctgtaccgcaaactccgcgccgtaatgtgcggcaaggggggcctgtaaacgttgtgcctggatttgaatgacctctgcgctgcgggtaagcaggcgcagggtcggtaatttttcactcagagcttcagggtgtaaataaagacgcaacgtggcttccagcgccgcgagggtcattttatccgcgcgtaatgcacgcttcagcgggtggctttgcaggcgggcgatcatctcttttttaccaacaataattcctgcctgcggcccgcctaacaacttgtcgccggagaaactcaccagactgacgcccgccgcaatcaactcctgcggcattggctctttcggcaaaccgtactggctaagatcgaccagcgagccactgcctaaatcagtcactacgggaacatccagctctttgccgagcgccaccagttccgcttcatctatcgctttggtgaacccctgaatgctgtagttactggtatgtactttcatcaacagtgcggtattttcattcaccgcctgacgataatcattcgcgtgcgtgcggttggtggtccctacttcgtgtagggtgcagcctgcctgacgcataacatcgggaatacgaaacgcgccgccaatctccaccagttcgccgcgagataccaccacctcttttccgctggcagtggccgccaacatcaataacaccgccgccgcattgttattgacgatacaggcatcttccgcccccgtaatacggcacagcagctgcgccagcgcccgatcgcgatgtccgcgtccggcgtcgtccagatcatactcgagggtcactggcgaacgcatagcctgcgcaacggcttccaccgcggcttccgcctgtaaagctcgcccaaggttggtatgcagcacggttcccgtcaggttgatcaccggacgcagcgcgctctgcgcttctttcgtcaaccgggcatcgacttcttgcgcccagttttcacaccacgcaggcagcgtctggctgccacgaatcacttctcgcgcttcgtcgagcatctgacgcaacaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcgcgcatcaagcctttggcggttcggtgcgagcaaaactttcgcggctaaacaggttttcgaccagtttgactaagtgtgggcggtcgacacaccaacctggcgcaacgcggcggaaattgagatatccgacggcacaggcaatggcgatagtcgccagattgaccgtatcggttttgagtgtgccatcgaccagatatccttccagcacatccagactgcggttgattttctcccgctggcgtaacaattcatcttcagactgctgcgccgctggacgcgcctgttcacgcaccgataccagcccggcatccataatgccatccgccagtgcctcaattttgcgcacccgcaacgactccagcggatcgcgcggcaacatcgccggagcgacattcattaattcaatatattcagcgatgatcggcgaatcaaaccagcattcgccctcttcggtcaccagcaccggcacttttcctaacgggttaaattgcgccacgccgttgtccgcgttatagggcagttcattaataaattcgaaagttatgcccttttctaacaacagaatagaaagtttgcgtacaaacgggctggtgtagctaccgacgagtttcatgccgagtcctttgtgcgaggaaaaatatcagtatggcctggtgatgggaaaaagggcagaaaatgttgatggtttgttacttccaaataaatcacatatttatcatggtgatataaatattttcctaattatttcactctgatggatatctcacttcaggctttcttataaatctgtagggtttcgcctgtcagcagacaaataacccgataaaacaaggatgagaaatgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctaacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacaatacagaacgacagaacccgcatccagacgatttatcagccggggagcttcacgccactcatcagagttgaaaccgccaccggtgagctggcgaaaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcccttatcagcaaggaagggacaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcggtatatcactcaggatccgattgggctgaaggggggatggaatttttatcagtatccgttgaatccagttacgaatacagatcctctggggttagaagtttttcctagaccattccccttgccaattccatggcccaaaagccctgcacagcagcaagcagatgataatgctgcaaaagcattgacaaaatggtggaacgatacagcatcacaaagaatatttgactctctaatattgaataatccgggactagcattagatataacaatgatagcttctcgtggaaatgttgcagacacagggataactgatcgtgtcaatgacataataaatgacagattctggagtgatgggaaaaaacccgacagatgtgacgtacttcaggaactaattgattgtggtgatattagtgctaaagatgcaaaaagcacacagaaagcctggaattgtcgtcactccagacagtcaaacgataaaaaaagatagcccttgtggaggttcctgcaatgtcaaatacataccagaaaagaaaggcaagtaaagagtatggtttatataatcaatgtaagaaactaaatgatgatgaattatttcgcttacttgatgatcacaattccttgaaaaggatttcatctgccagagtattacagttaagaggtgggcaagacgctgttagattggcaattgagttctgctctgataaaaattatatccgtagagatatcggagcatttatactcgggcaaataaaaatttgcaaaaaatgcgaagataatgtttttaatattttgaacaatatggcattgaatgataagagcgcttgcgttcgagctacggcaatcgagtcaacggctcagcgatgcaagaaaaacccaatttattcacctaaaatagtagaacaatctcaaattactgcttttgataaatcgactaatgtcagacgtgctacagcatttgctatttctgttatcaatgataaagcaacaattccactattgattaatctgttaaaagatccaaatggagatgtcagaaactgggccgcatttgcaataaatatcaataaatatgataatagtgatattagggattgttttgtggagatgcttcaggataaaaatgaggaagtccgtattgaagcaataatcggactttcctacagaaaagataaaagggttttatctgttttatgcgatgagttaaaaaaaaatactgtttatgatgatatcattgaagctgcgggtgaattaggtgataaaacgctacttcctgttttagatactatgttgtacaagtttgatgacaatgaaattataacttccgctattgataagctgaagcgttcatagcgtgagttgcctatgcacagtgggggattcccgccggcacggtgcagatgctcgaccggctggaaagtgaaatcctggctgaccgggtgagtgaggaaagccgccgctggctggcatcgtgcggcctgaccgtggagcagatgaaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgagtgatgagaacccgcatcatctgcagcagctcattcgcctgccgggtcagcagtatgatgaggagtccggcctgtattacaaccgccaccgctattatgacccgctgctggggcggtatatcactcaggatccgattggactgaaggggggatggaatttttatcagtatccgttgaatccggtcataaatgtagatccgcaaggtttggttgatataaatttataccccgaaagtgatcttatccattctgtagctgatgagattaatatcccaggcgttttcacaatcggggggcatggtacccccacatctattgaatccgcaacgcgcagtatcatgacagctaaagatctagcatatctaattaaatttgatgggaattataaagatgggatgacagtttggttattttcttgtaatacaggtaaaggacaaaattcatttgctagctaattagctaaagagttacatacaaatgtaataggacctgacacgctatggacgtggtgggggcgaggaactaatggtaagttaaaaatggatacagtgctaacagcaccaacgaaccttaattcaaataaggatctaatggctataacaacaaaagaccttggtaattggataacatatgggccatctgggcaccccatttctaatatgcaaggtacgccagaaaaacccagtgatataagataggttgtagatgtatgaaagcatgcttgttactatttttttatttctcttttatttgtcaattgcatggtgctgatgtgaaaataaaacaaaacgaaagtatgatggggtctacagcaatgacctatgatttaagtgaagaaaagttgatgaaactgaagtataaatcacaacatggtgattcagaggcatcatttcgactatatcaatattactgctttactaaaaataacatttacaaacaattgcgattcttggaaagatcagcatctcaggggaatgttacagcgcagtttaattatggggtctttttatcagatacaaatccaacattatcagaatattataatttgaatagagctatttattggatggaattcgctgtaaataacggtaatattgatgcaaagagcaaacttcaagagctcaaaaagctaaagcgaatggatagaaggaagaataaggagaatccgtaaaagcaatagttcatcagactgccgcagcagtagtatgatgatgaatcagggctgtactataactattatcggtaacattaaccgcagcaggggcggtataacactcaggctccgattgggctggaaggtaggtggaatttttatcagtatccgttgaacccgatttctggaatcgatccccttgggattagccacctgtttatacagcataactttaggtatgctttcgtgtgtttcagatataccatgtgatgataatttttatgatgtgcttagtattccagtcgcttctggtaataatatgcaatgtaaaaataatccccgttgtacacatttataaatagatggccaatacctcaaggcctatggagttggaatgttaatgacccgggagcaagcaatagaaaacctgacggcatacgattagtaccgtcagttaatacaggaacttataatcgcaatggattttcaatacatagttgtttaaacgcttttggtccgtctttaggacctcgattctgttccgagggttgtataactggtttatctaatgacatgcaaaaattaaatgagttaatattttcagagccagatagcacattaacagttacggactaaaaaatatggcaaggttattaacaattgtatttttttctctatttctgcgagtgcagttactgcaagacaatttcagagagagttagatttggcagacaaagcaatattatgggcactaatatcagccagtactaaagagggacgaaaagcgtgttcactaagctattttgcctgtaaggccgcagaggctgaactcggactggcatatatggctgcgaatgataacaaggaatttctcacatccttatctaatataatgaggtacaaaatagatgctggactttccgaatcctatacatgctatttattaagtaagggaaagatcataagaccatatctgaaaaatctaaatccactccaacttgccgctgattgcattgaaacagtaaataaaataaaagataagaataaaaaaaatcattgatataaattcagttaatatttgtagtgatgataaaaatataaaattgagagttaatagtactattatggccattgatgattctataaagtgcatcgatgaatgataacttaattttatttaaaaatatattaataactcactctccaggagtttttttaacttagttttataatgaatacgataattaaaagtgaagaagaaaatagttgtatacatatattccatgaccctacattgtgatctatagattaaatattttttaaatgtgactgtcatccttcagataataaagccatcatcgcaatagatggaaaagcactcctgctcttttttgattagagccgtcgcaggaggaacaactcatatcatcattgcgatctcgacgatgtatagtctcatcctgcggcagaacaagacggataaaaaatccaatgagagcacactcatccagaacttattaacataatgaatattaaagaaaaatcatcgaagctaatgaagtaatatgcaaaaataattagtccttacaaggagcaaagttccataatctcccccctccccctcaatgatccaaataaagataatgcatccagctggtcattcttagcagcactttccgcatcaccgaaacatggctgaaatggtcggagtaaaccgccacctgggcgtagatgccgtcgggtaaggcatcgatatcatcgttagggtccagttcaatggttcccagcacaccgtccgtgccgggcacgaccgttaatgattgcaataccccctgcgcctgataagaaccgcctggcacgacaggtaaaatactagtcagtttgccgtgaaacacctgcccaggtagcgcgttaaacaccacttccgcatcatcgccaggtttcagacgtaacagcgagttttgccgaaattgggcgacaatttgccgtttttgctcggggatgaagaccatcaccggacgcagcggcaaggcagctgcgtatgtacctgggcggatcagtacctgagtaacgtagccattgctcggcgcgcgaatgacagtctgctcaaggttatattttgcttcagtaagttgcgctcttaagctcacaatctgcgattgctcgccgttaaccatactgtcgagctggctctggatctgcgcctgctccgccaccgagcctttcaccagcgcatcctgcgcgaggaaattttgccgcgcatcgtcgatgtcacgttccgagaacggattcaccgccgcctggctgcctttcaagtaacgttgataatttttaaacagacggtcgcgctccgctgaaacctgggtggtgttggcctgcgcttcagtgagctgcgcacgcagcgtctttatattatgcgtcgccgtcatcaggtcagcctgaagtctgtcaactcgcgcctggtaacgaaccgggtcgagcttaaaaagcacctcgcccttttgaataagctgattattcttgtcagtgacttcagtaacaattcccgtcacctgtggcgtgatagggatcgctatcactgccttttgcgcggtaaaagtgtaagggtggttgtagttcatcaacaaaatcaaaccactcaccagaaacacgcctcccagcgccgccgtcgccagcgtccactgatttaccggaatgcggaagattttaaagaccgcccacgccagcgccacgtaagttaaaacaatcaatagatccataattagatctccgggaacgtggaatagtcagtctttttctcggcggcgagttgatgctccagccgggaaattcggtcagaaagtgcggcgatttccgggtcagtcgctttctcctgcgacgcaacatgtgactgcataccccagccacgctccggttgatagagcgtcgcccagatccacagaaacggccagataacatgcagagtaaacaggctcacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgtttttgggctggcagccagaagggagtcaggctgatattttgacaataatccgggttcgcgattctcgccataacaccaaagaataatttttagaggtgatgagttgcttagttacataacgattgtatgacgaaggcataacatgctgtagatcacatcaggtgaacgccgtaagaaaatatcttgtgattcagatcacaaagattcaacaaaccatcaaaacaaaaatgtgacactactcacatttaaatgccatttttagcgaaaatcgccgccttgttgcttttttacacaagcgttttgtgatgaacgtcacgtcaattacctctctaccccctatatttatgtgattgatatcacacaaaaggccgtcgactggacagttaaccgattcagtgccagatttcgcagtatctacaaggtccggctacctctgccgccacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgagacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagacatgccgatgttcctcggttctatgattgcaggtccgctgggcggctggtgcattaagcacttcgaccgctgggtagacggtaagatcaaatccggttttgagatgctggtgaataacttctccgcaggcatcatcgggatgatcctcgctattctggcattcctcggcattggcccgattgttgaagccctgtccaaaatgctggctgcgggcgttaacttcatggttgtccatgacatgctgccgctggcgtctatctttgttgaaccggcgaaaatcctgttcctcaacaacgccattaaccacggtatcttctcgccgctgggtattcagcagtcccatgaactgggtaaatcaatcttcttcctgattgaagctaacccaggtccaggtatgggcgtgctgctggcgtacatgttctttggtcgtggtagcgctaaacagtctgcgggcggtgcggcaatcatccacttcctggggggtatccacgaaatctacttcccgtatgtgctgatgaatccgcgtctgatcctcgcagtcatcctcggcggtatgactggcgtgttcacgctgactatcctgggcggtggtctggtttctccggcatctccgggttctatccttgctgtactggcgatgacaccaaaaggtgcttacttcgctaacatcgcgggtgtgtgtgcggcgatggctgtctccttcgttgtctctgctattttgctgaaaaccagcaaagtgaaagaagaagatgatattgaagcagcaactcgtcgtatgcaggacatgaaagctgagtctaaaggcgcatctccgctgtctgctggcgatgtgactaacgacctgagccacgtacgtaaaatcatcgttgcctgtgacgccggtatgggttccagtgcgatgggcgcaggcgttctgcgtaagaaaattcaggatgcaggtctgtcgcagatttctgttactaacagcgcgatcaacaacctgccgccagatgtggacctcgtcatcactcaccgtgacctgaccgaacgcgctatgcgccaggttccgcaggcacagcatatttcgctgaccaacttcctcgacagcggcctgtacaccagcctgaccgaacgtctggttgctgcccaacgccacacggcaaacgaagagaaagtaaaagacagcctgaaagacagctttgacgattccagtgctaacctgttcaagctaggcgcggagaacatcttcctcggtcgcaaagcggcaaccaaagaagaagcgattcgttttgctggcgagcagctggtgaaaggcggttacgttgagccggaatacgttcaggcgatgctggatcgtgaaaaactgaccccgacttatctgggtgagtctatcgcggtgccacacggtacggttgaagcgaaagatcgcgtactgaaaacgggcgtcgtgttctgccagtacccggaaggcgtgcgcttcggtgaagaagaagatgacattgcccgtctggtgattggtattgctgcccgtaacaacgagcacattcaggttatcaccagcctgaccaatgcactggatgatgagtccgtcatcgagcgtctggcacacaccaccagcgtggatgaagtgctggaactgctggcaggtcgtaagtaatccaatcccaccctctccacatggagaaggtggggttaattgcctgatgcgctacgcttatcaggcctacaggatgcatcacaatttgttgaatttgcacgttcttgtaggccggataaggcgcttacgccgcatccggcgctgcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcagacgcgggtatccaactgacgtttgccgatgtcaatcaggtggtacttgatgccctgaatgcccgtcatagctatcaggtacatgtggttggtgaaaccgagcaggtagataccgtttccggcgtcaatgctgtcagcagcattggtgatgatgtcgttgatctgattgctcaggttgatttagtcactaccgccgttggcccggttgtgctggaacgtattgctccggcaatcgccaaagggcaggtgaaacgtaaagaacaaggtaatgaatccccgctgaacatcatcgcctgtgaaaacatggtacgcggtaccacgcagctgaaaggccatgtgatgaacgccctgccggaagacgccaaagcgtgggtagaagaacacgttggctttgtcgattccgccgttgaccgcatcgtaccgccttcggcttcggcaactaacgatccgctggaagtgacggtagaaaccttcagcgaatggattgtcgataaaacgcagttcaaaggcgcactgccgaacatcccaggcatggagttaaccgacaacctgatggcatttgtcgaacgtaaactcttcaccctgaacacgggtcatgctataaccgcgtacctcggaaaactggccggtcatcagaccattcgtgacgcgattctcgacgagaaaatccgcgcggtggtaaaaggtgcgatggaagaaagtggtgcagtattgatcaagcgctacggctttgacgctgacaagcatgcggcgtacatccagaaaattctcggccgttttgagaacccgtatctgaaagatgatgtagagcgcgtaggccgtcagccactgcgtaaactgagtgctggcgaccgtctgatcaagccactgctcggtacgctggaatatggtctgccacataaaaacctgattgaaggtattgccgctgcaatgcacttccgcagtgaagatgatccgcaggctcaggaactggcagcactgatcgctgacaaaggtccgcaggcggcgctggcacagatttccggtcttgatgccaacagcgaggttgtatccgaggcggtaaccgcttataaagcaatgcaataatggtggaccaggcgcaggacaccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcctttaccgacgacgaaatccttggaccctttggtgaactgcactgcgtggcggcgttaccaccgccgccacagtttgaaccagcagactccagtttgtatgcaatgcaaattcagcgctatcaacaggctgtgcgatcaacaatggtcctttcactgactgagctgatttccaaaatcagcttaaaaaaagcctttcaaaagtaagcaacgtctgcttactgcccctctacctgcttcggccgataaagccgacgataatactccagacgttgtagatataacggcacgctttcatcgggtattccggacggaatcgcgttacggggaggaagttttttcagatactcccggaacgcctggcttgatgccatgaaatctacggctttatcgataagaagcggaacgttttcacctaatttgcccatgatgatatctccgtattaccccgcgccgggaatgcgcggccgccaattttagtttaggttcccggtaaagatgacattaaggaaaacgtgctgaatcctcaataatcatccgctgctgtttattatcttttttctatagatttcttaattaatcaacgaattgcgcagtttttgagcatgttaatgattacgttacagaactattacaatgtcattagttgtgaacaaagcacctggtcgcgcatactaggggctataaatttatctttatcagaagccatcacatgaaagaagtcgaaaaaaacgaaatcaaacgcctcagcgatcgcctggacgccatccgccaccagcaggccgatctttcgctggttgaagccgcagacaaatatgccgagctggaaaaagagaaagccacgctggaagcagaaattgctcgcctgcgtgaagttcatagccaaaaactgagtaaagaagcacagaagctgatgaagatgccattccagcgcgcaattaccaaaaaagagcaggctgatatgggcaagctgaagaaaagtgttcgcggactggtcgttgtgcacccaatgaccgcactgggccgcgaaatgggcctgcaggagatgactgggttttcaaagaccgcgttttaagaacacagtatctacagggtgattctgcacattcctataggccgagtaaggtgttcacgccgcatccggcaagataaggcgctctggatcaacaacctaagggcaattctctgatgaggattgcccttttctttaccagacatctccccccacaagaattggccctaccaattcttcgcttatctgacctctggttcacaatttcccaattaaaactcacatcaatgttgccaatacataacatttagttaaccattcattgtcattatccctacacaacacaattggcagtgccacttttacacaacgtgtgacaaggagatgagcaacagactcattacacgatgtgcgtggactccaggagacctgcaatgaatctctggcaacaaaactacgatcccgccgggaatatctggctttccagtctgatagcatcgcttcccatcctgtttttcttctttgcgctgattaagctcaaactgaaaggatacgtcgccgcctcgtggacggtggcaatcgcccttgccgtggctttgctgttctataaaatgccggtcgctaacgcgctggcctcggtggtttatggtttcttctacgggttgtggcccatcgcgtggatcattattgcagcggtgttcgtctataagatctcggtgaaaaccgggcagtttgacatcattcgctcgtctattctttcgataacccctgaccagcgtctgcaaatgctgatcgtcggtttctgtttcggcgcgttccttgaaggagccgcaggctttggcgcaccggtagcaattaccgccgcattgctggtcggcctgggttttaaaccgctgtacgccgccgggctgtgcctgattgttaacaccgcgccagtggcatttggtgcgatgggcattccaatcctggttgccggacaggtaacaggtatcgacagctttgagattggtcagatggtggggcggcagctaccgtttatgaccattatcgtgctgttctggatcatggcgattatggacggctggcgcggtatcaaagagacgtggcctgcggtcgtggttgcgggcggctcgtttgccatcgctcagtaccttagctctaacttcattgggccggagctgccggacattatctcttcgctggtatcactgctctgcctgacgctgttcctcaaacgctggcagccagtgcgtgtattccgttttggtgatttgggggcgtcacaggttgatatgacgctggcccacaccggttacactgcgggtcaggtgttacgtgcctggacaccgttcctgttcctgacagctaccgtaacactgtggagtatcccgccgtttaaagccctgttcgcatcgggtggcgcgctgtatgagtgggtgatcaatattccggtgccgtacctcgataaactggttgcccgtatgccgccagtggtcagcgaggctacagcctatgccgccgtgtttaagtttgactggttctctgccaccggcaccgccattctgtttgctgcactgctctcgattgtctggctgaagatgaaaccgtctgacgctatcagcaccttcggcagcacgctgaaagaactggctctgcccatctactccatcggtatggtgctggcattcgcctttatttcgaactattccggactgtcatcaacactggcgctggcactggcgcacaccggtcatgcattcaccttcttctcgccgttcctcggctggctgggggtattcctgaccgggtcggatacctcatctaacgccctgttcgccgcgctgcaagccaccgcagcacaacaaattggcgtctctgatctgttgctggttgccgccaataccaccggtggcgtcaccggtaagatgatctccccgcaatctatcgctatcgcctgtgcggcggtaggcctggtgggcaaagagtctgatttgttccgctttactgtcaaacacagcctgatcttcacctgtatagtgggcgtgatcaccacgcttcaggcttatgtcttaacgtggatgattccttaatgattgttttacccagacgcctgtcagacgaggttgccgatcgtgtgcgggcgctgattgatgaaaaaaacctggaagcgggcatgaagttgcccgctgagcgccaactggcgatgcaactcggcgtatcacgtaattcactgcgcgaggcgctggcaaaactggtgagtgaaggcgtgctgctcagtcgacgcggcggcgggacgtttattcgctggcgtcatgacacatggtcggagcaaaacatcgtccagccgctaaaaacactgatggccgatgatccggattacagtttcgatattctggaagcccgctacgccattgaagccagcaccgcatggcatgcggcaatgcgcgccacacctggcgacaaagaaaagattcagctttgctttgaagcaacgctaagtgaagacccggatatcgcctcacaagcggacgttcgttttcatctggcgattgccgaagcctcacataacatcgtgctgctgcaaaccatgcgcggtttcttcgatgtcctgcaatcctcagtgaagcatagccgtcagcggatgtatctggtgccaccggttttttcacaactgaccgaacaacatcaggctgtcattgacgccatttttgccggtgatgctgacggggcgcgtaaagcaatgatggcgcaccttagttttgttcacaccaccatgaaacgattcgatgaagatcaggctcgccacgcacggattacccgcctgcccggtgagcataatgagcattcgagggagaaaaacgcatgattatttccgcagccagcgattatcgcgccgcagcgcaacgcattctgccgccgttcctgttccactatatggatggtggtgcatattctgaatacacgctgcgccgcaacgtggaagatttgtcagaagtggcgctgcgccagcgtattctgaaaaacatgtccgacttaagcctggaaacgacgctgtttaatgagaaattgtcgatgccggtggcactggctccggtgggtttgtgtggcatgtatgcgcgtcgtggcgaagttcaggcagccaaagcggcggacgcgcatggtattccgtttactctctcgacggtttccgtttgcccgattgaagaagtcgcgccagccatcaagcgcccaatgtggttccagctttatgtactgcgcgatcgcggctttatgcgtaacgcgctggagcgagcaaaagcagcgggttgttcgacgctggttttcaccgtggatatgccgacaccgggcgcacgctaccgtgatgcgcattcaggtatgagcggcccgaacgcggcaatgcgccgctacttgcaagcggtgacacatccgcaatgggcgtgggatgtgggcctgaacggtcgtccacatgatttaggtaatatctcagcttatctcggcaaaccgaccggactggaagattacatcggctggctggggaataacttcgatccgtccatctcatggaaagaccttgaatggatccgcgatttctgggatggcccgatggtgatcaaagggatcctcgatccggaagatgcgcgcgatgcagtacgttttggtgctgatggaattgtggtttctaaccacggtggccgccagctggacggtgtactctcttccgcccgtgcactgcctgctattgcagatgcggtgaaaggtgatatagccattctggcggatagcggaattcgtaacgggcttgatgtcgtgcgtatgattgcgctcggtgccgacaccgtactgctgggtcgtgctttcttgtatgcgctggcaacagcgggccaggcgggtgtagctaacctgctaaatctgatcgaaaaagagatgaaagtggcgatgacgctgactggcgcgaaatcgatcagcgaaattacgcaagattcgctggtgcaggggctgggtaaagagttgcctgcggcactggctcccatggcgaaagggaatgcggcatagtcgtttgcgccccctcaccctaaccctctccctcagggagaggggaccgttcggcgctgtatgtactccctcactctgaaacgacaccgcactctttttttctccctcgcccctccggggagagggccggggtgaggggaaaaggccgcactgctcaccaattttctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgttcctcgaagcagaaaatccccagcgcctgttcgccctcaccacgaaaggtacacctgctcacagcgccgtaagctatcaggatggcgattatctgatgttcggcccggaaacacgcggcctgccagcgagcattcttgatgccctgcccgctgaacaaaaaattcgcattccgatggtgccggacagccgcagcatgaatctgtccaatgcggtgtcggtagtggtgtatgaagcctggcggcagttggggtatccgggagcggtattgagagattagttactgtaggccggatagatgattacatcgcatccggcacgatcacaggacattagatcccatccccatactcaaatgtatggttaataccgttgaaatgctggtccatatccattgatggcttatcgctgtctggtttaccgacaatacgagccggaacgccagcggcggtggtatgcggcggcaccggttgcagcaccacggaacctgcgccaatcttcgcgccgcgcccaacttcaatattgccgaggattttcgcgcccgcgccaatcatcacaccttcacgaattttcgggtgacggtcaccaccagatttacccgtaccgccaagcgtcacagattgcagaatcgatacgtcgttttcaatcaccgccgtttcaccaacgacgatgcctgtcgcgtggtcaagcatgataccgcgaccaatttttgctgccgggtgaatatcgacctggaacgtcacagaaacctggttttgcagaaagattgccagtgcgcgacgcccctgattccacaaccagtgaccgatgcgataggcctgcaaggcatgaaaacccttcaggtataacaacggggttgagtatttatcgactgccgggtcgcgggtacgcaccgcctgaatatcacaggccgcagaggcgatcatttccgggtcagcggcgtaggcttcttccaccacttcacggatagcaatagcaggcataattggcgatgacagcttgttcgccagcatgtagctcagtgcactgccaaggttttcgtgcttgagtagcgtcgcgtggtaaaaactggccagcattggctcacagtccgccagcgttctggcttcggctttaatattgttccagacaatttccagttcttcacacgacattgcttactccacacgatgagataatgaccggcccgttctgcgcgggccgggtcatagcggtaacaaaggttccctggggttagtggctgctgcgctcgtccttgcgtgcacgacctagtaaagtcaatgctgcctcgcgcgcgttttttccgcaatataatacttgataaatttcctcggttattggcatttcaacgccgaagcgatgcgccagttcgcggacttctttcgtattgcggtagccttccaccacctgaccaatcttctcctgcgcgctttgtacatccatgccctgaccgagcatcatgccaaaacggcggttacgcgactggttgtcggtacaggtaagcaccagatcgccaagccccgccatgcccataaaggtggcagggtcggcacccagcgccgcaccaagacgcgacatttcagccagcccacgggtgatcagcgccgtacgcgcattcgcaccaaaaccgataccgtcggacatccccgcaccaatggcaataacgtttttcaccgcgccgccaagctgcacgccaatgaaatccggattgctgtaaacgcggaaacttttgccgcagtgcagcagctgctggagatcatcggcaaaggtctgatcggtcgaggccagcgaaatagctgtcggtaaacctgccgccagttctttcgcaaacgttgggccagagataaccgccagcggaatttgatcgcctaaggcctcacgcgccacgtcctgtaacagacgtccggtttccgcttccagccctttggtcgcccacaccagacgcgcatcaggacgcatcagtggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtgatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgctcccaggcaatgcgccatctgggtgccttcgatacccgcgatggagaaaataccgccctgctgaacttcacacaggaacgcggtttcttcgcccaaagaggccgttacggtaacacgcagtaccacttcgtatacgtcatctgccagttgggaagatgccgtatccagatcaagtttaacttctggttgccaatctttctggaaaacgtgcggcgcgttcggcgcttcgaaagagatatccttggtataaatacgttggatctggaaagtcatttcagtgttgttttgttctgacatgtgtagaaaacccttaagtgttgtccttaaatactgcgcaatgtaatgccaacgttcacacgttatttcagcaggggatccagtccaccacgtgcatccaatgcatacaagtcatcacagccgccaatgtgctgtgcgtcaataaaaatctggggaaccgtggtgcgaccgctgcgtttgatcatctcttcacgcttggcggcgttgccatcgatcggcagctcctggaaactcacgcccttgctgctcagcagtgcttttgcacgatggcaatacgggcaggtttctttggtatagatttcaacattggccataaattagctcctgtttttttaccctgaaatttcatgttgcagggcggcagcaaaatggagtgtccccagaagcttataacaataagtcgctgggggcctaattgcagctaacggcctgcatcatgaaagacgacaggtaaattatttgccgcgcaccaaaggcaagttttcgccagcccagccagcgacgccttctttcagcacgaatacttgcgcaaaaccagctttcgtcagtgcgtttgcaggctcctggcactgcatgccagaaccgtctaccacgataaccggtttgtctttgtgcttctcaagctcaccaacattgttggctttgatttcgctcggcaacagattaatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcggtgcggcaaatacagccagcgcgttaactggaatgcaattttgcggggcgcgacgaaaaaaaagcgtaaatctggcatcggcttgccgcgagcggtcgtatattttgatcttcagaggctattttatcgattcagctgtagtaaaattacgcaaattttgactcttgagtatgaggttgtcgcaatgttggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttcttagcgctggcgtattgttgtgcgccttttccgcccacgcggatgagcgtgaccaactcaaatctattcaggctgacatcgccgcaaaagagcgcgcggtacgccaaaagcaacaacaacgcgcaagcctgctcgcacaattgaaaaagcaggaagaagcgatctctgaagccacccgtaagctgcgcgaaacgcaaaacacgctcaatcaactcaataaacagattgatgagatgaacgcgtcgattgccaaactggagcagcaaaaagccgcccaggagcgcagcctcgccgcacaactggatgccgcattccgtcagggcgagcataccggtattcagctgattctcagcggtgaagaaagccagcgtggacagcgtttacaggcttatttcggctatctcaaccaggcgcgacaagaaaccattgcccagttgaagcaaacgcgtgaagaagtcgccatgcagcgtgctgaactggaagagaaacagagcgagcaacaaacgctgttatatgagcagcgcgcccaacaggcgaaactgactcaggcgctgaacgagcgtaaaaagacgctggcagggctggagtcttccatccagcaaggtcagcaacagttgagcgagctgcgcgccaacgaatcccgtctgcgtaacagcattgcccgtgcggaagccgcggcgaaagcgcgtgcagaacgagaagcacgtgaggcccaggcggttcgcgaccgccagaaagaagcgacgcgcaaaggcaccacctacaaaccgaccgaaagcgaaaaatcgctgatgtcccgtaccggtggtctgggcgcgccgcgtggtcaggcattctggccggttcgcgggccgacgctgcatcgctatggcgaacagctacagggtgaattacgctggaaaggtatggttatcggtgcttctgaaggtactgaagttaaagcgattgccgacggtcgggtgattctggctgactggctgcaaggctacggtctggtggtggtggttgagcatggtaaaggcgacatgagtctttacggctataatcagagcgcactggtgagcgttggttcgcaggttcgcgcgggccagccgattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtacttgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcgcataacagcgggcacgaagtgttgattcatctcccgatggcaccgttgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtattcctcgacgattcgcaaaatgaagcggacatccgtgtgcaatttaatcgcgcaattgacctggcgcgtcgcaacggttcgaccattgccattgggcatcctcaccctgcaacggtacgcgtgttgcaacagatggtttataacctgccgccagacattacgctggtgaaagccagcagcttgctgaatgaaccgcaggttgatacttctacaccgccgaaaaacgctgtgcctgatgcaccgcgtaatccgttccgtggcgtgaagctgtgcaaaccgaagaaaccgatagaacctgtttatgctaatcgcttctttgaagtattaagcgaaagcatcagccagagcacgctgatcgtttacttccagcatcagtggcaaggctggggcaaacagcccgaagcggcgaagtttaacgctagcgcaaattaaaggcgctacgcgtaatgcgatggtgcgaccgcgttttgtcgcgccattgccataagcggaaagaccacagtaacgcctggtaaccgaccttcacgctgcgcacattggtaatcaggcgcttatacataccggaagtaaatatctcggcaatcatccgttggcgggtaagaatatccggctctttgcgcaccgcatggcaaacacgcaatgcctcgtaagttatttgctgatgaaattccggataaatcataattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacatgaattctgttgtccagacaatatcctgatgatgtaatccggcaataaatttaatgttatttttaacaataacatcacggcgataaacccccatccagacaacgtgagtccaacggcgcgaagaaagccccatccgcagccagtccgggccggttaatacgccggttgagcgaaggcgatcggtggggatggattgccaggtttctcccgtttcacgaaaacaccagtcagcgttgcactgcgccacgtcgaggtcgtcctctaacgccatggtcatcagcgtttcgtacatggtgggatagacttcatcgtcagcatcgacaaaagcgacatatttgcccgttgccacttcaatcccacgattacgcgccaccgatgcgccagcattcgcctgatgcaacaaacgaacgtgcggatagttttctgcgtaatactttgctatttcaacagaattatccgttgaaccatcgttaataataatgatttccagagcagtccaggtttgcgtaattaaagattccatacaagtgcggaaatcatcgcccgcattatataacggaataataacactaagtttattggtgctgttcatcataaattaccgacgacctctgaagttatcctgacgttttacaggctttgtattaagaaactattaagcctgtgagatattatttttacaggtgagagagtcacttcagggtagagagataatgagagcagctatataagagatcagcacaattacgaactctttattacactgacaggattttacatatttaacagattatcctcagataaaagggctggaataccagcccttgttcgtgttaatcccagctcagaataactttcccggactggcccgaacgcatagcgtcaaagcccttctggaaatcatcgatagagaaacgatgggtaatgatcggcgaaagatcgaggccagactgaatcagcgccgccatcttgtaccaggtttcaaacatctcacgaccgtaaatacctttaatgaacaagcctttaaagatcactttggtccagtcgatagacatatcagacggcggaatacccagcatcgcaatacggccgccgtgattcatggtgtcaagcatggtacgaaacgctggcggcgcaccggacatttccagaccgacatcaaaaccttcggtcatgcctaactccgccatcacgtcattgagattttctttggcgacgttaaccgcacgggtgatacccattttacgcgccagctcaaggcggtattcgttaacatcagtgatcaccacattgcgtgcaccaacgtgtttcgccaccgccgctgccataataccaatcgggcctgcaccagaaaccagcacatcttcgcccaccagatcaaacgacagcgcggtatgcacggcgttaccgaagggatcaaaaattgcggctaagtcatcggaaatattgtcggggattttgaaggcgttgaatgccgggatcaccagatattcggcaaagcagcccgggcgattaacaccaacgcctatcgtgttgcggcacaaatgggtacgaccaccacgacagttgcggcaatgaccacaggtgatatggccttcgccagaaacgcgatcgccgatcttgaagcctttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacatcctcaggcgataacgcccagttgtttaccaatacgcgtaaatgcttctactgcacgcgtaatttgctcaggggtatgcgccgcagacatctgggtacgaatacgcgcctgacctttcggaacgaccggatagaagaaaccggtaacgtaaatgccctctttttgcagctcacgggcaaatttctgcgccactaccgcatcaccaagcatgaccggaataatggcgtgatcggctcccgccagggtaaagcccgccgccgacatttgctcacggaactgacgcgcgttcgcccacagacggtcacgcagttcgctgcccgcttcgaccatctccagtactttgatggacgcggcaacaatggccggtgccagcgagttggagaacaggtacggacgagaacgctggcgcagccactcaaccacttctttgcgcgccgcggtataaccaccagaagccccgcccagcgctttaccaagcgtaccggtgataatatcgacccggcccatcacatcgcagtattcatgggaaccacgaccattttcaccgacaaaaccgaccgcgtgggagtcgtctaccatcaccagggcatcatatttatctgccagatcgcaaacgcccttcaggttggcaatcacgccgtccattgagaacacaccatcggtggcgatcagcacatgacgcgcaccggcttcacgcgcttctttcagacgtgcttccagctcctgcatatcgttgttggcatagcgatagcgtttagctttgcacagacgcacaccatcaataatagacgcgtggttcagtgcgtcggagataatggcgtcttccgcacccagaagcgtttcaaacaggccaccgttagcatcaaagcaggaagagtagagaatcgcatcttccatccccaggaaggccgccagtttttgttcaagctctttatggctgtcctgagtgccgcaaataaaacgcaccgaagccatgccgaaaccgtgagaatccattcccgcctttgccgccgcaatcagatcaggatgattcgccagcccgagatagttgttggcacaaaagttaatgacgtggcttccatcagccacagtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagataacgcgttaacacttctgcaaaattcaggataaataacgtgtaacttgatgtctctcaacacctacagatagtagaaaaactgtacagttttggctgggcataatgatgattgattttactgcattgatataaaaagaaaaaatgatgccaaagcatcatttttcctatctcagttggtatcaaaacgctacccactaatggagggaaacctattttcttgaaaggaaaattctcagcgcctgcatttttgcccctaaagtgttactcctgaagcagcgaaacaaatcgaaccattttcctctccccagatagtttaggttgaagagatcggggcgtttgtaatagcacatgacaaaaatgccctggtcatcgtccacaatgttattatttagtgttattttttgactttccagaactaatttatagaattctttccatttatgctgtgaaccaacaattgcgcccccaataatatatacatgattgccaatcatgaaatcaaaaacctgttgttgagatgtgacagtaagccctttttttatagtgaaaagatgcatcttactttcatcaaatgggaaatcccaaattttcaatcctcgagttacatttggcttatggcaatagccaaaatctatccacgcaacaagaggcgttttcactaagcccatgttgatagctttatttacaaaataggccttaaggttacataccaaaacatactctggtgaccagtactctgggttttttaattgtcgaggctcaagtctatttgtaaacgactcatctttttgaattttttcgatacgacttctgatatatctaaatttcttttttatatcgataacgataaccgttgttggttttccgttgcgaatcgcttcaacccttggtttcaaatcgggagaagtgaaaataatcatctcattttcaagtgcggccagacgctcaaagtaactaaaataaacatcaactgaacgagctagtttttcacggaaccctttattagcagtccaatcccctctaccaatgtcaaaatatgcagtgataattgtggtggatgatttcattactaataagaccattaatataaaaaaagaattatatcataaatattaatagaatgtatactgtatattatccattcaaatgcttccgttatttatcatacatcggaatattgatactaaagcactattcacatgcaaaaccaacatccgccatgaaggactagctaaaacccaaactagtttgttgcaattagcatccttgcacctctatgtaaagggctgaagggattcggatgtgatggtatgattacagacattcgtgtctgagattgtctctgactccataattcgaaggttacagttatgatcatcgttaccggcggcgcgggctttatcggcagcaacatcgttaaagccctgaatgataaaggcatcaccgatattctggtggtggacaacctgaaagacggcaccaagtttgtgaacctggtggatctgaatatcgcagactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaggagctgctgcactactgcctggagcgtgaaatcccgttcctgtacgcttcttccgcagccacctacggcggacgcacctccgactttattgaatcccgcgagtacgaaaaaccgttgaacgtctacggttactcaaaattcctgtttgatgaatatgttcgtcaaatcctgcctgaagcgaactcgcagattgttggcttccgttatttcaacgtttatggaccgcgtgaaggccataaaggcagcatggcgagcgtcgctttccatctcaacacccagcttaacaacggtgaatcaccgaagctgtttgaaggtagcgagaacttcaaacgcgacttcgtctatgtgggcgacgtggctgatgtgaatctgtggttcctggaaaatggcgtttccggcatcttcaatctcggtactggtcgtgcggaatccttccaggcggtagctgatgctacgctggcttatcacaagaaaggccagatcgaatacattccgttcccggataaactgaaaggccgctatcaggcgttcactcaggcagatctgacaaatctgcgcgcggcgggttacgacaaaccgttcaaaaccgttgctgaaggtgtaacggaatacatggcctggctgaatcgcgacgcataagagctctgcatgaaaatactggtgatcggcccgtcttgggttggcgacatgatgatgtcgcaaagtctctatcgcacgctccaggcgcgctatccccaggcgataatcgatgtgatggcaccggcatggtgccgtccattattatcgcggatgccggaagttaacgaagctattcctatgcctctcggtcacggagcgctggaaatcggcgaacgccgcaaactgggtcatagcctgcgtgaaaagcgctacgaccgcgcctacgtcttacccaactccttcaaatctgcattagtgcctttcttcgcgggtattcctcatcgcaccggctggcgcggcgagatgcgctacggtttactcaacgatgtacgcgtgctcgataaagaagcctggccgctaatggtggaacgctatatagcgctggcctatgacaaaggcattatgcgcacagcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaagcgggcaatgagattcttgccgctttgaataccgagcagcaggcatggtgtcggaacctggcgggggaaacacagcttgatcaagcggttatcctgattgcagcctgtaaagccattgtcactaacgattctggcctgatgcatgttgcggcggcgctcaatcgtccgctggttgccctgtatggtccgagtagcccggacttcacaccgccgctatcccataaagcgcgcgtgatccgtttgattaccggctatcacaaagtgcgtaaaggtgacgctgcggagggttatcaccagagcttaatcgacattactccccagcgcgtactggaagaactcaacgcgctattgttacaagaggaagcctgacggatgcgggttttgatcgttaaaacatcgtcgatgggcgatgttctccatacgttgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggcccccataaaagcggaacgcaaagcgtttcgtgaagcgctacaagcagagaactatgacgcagttatcgacgctcaggggctggtaaaaagcgcggcgctggtgacgcgtctggcgcatggcgtaaagcatggcatggactggcaaaccgctcgcgaacctttagccagcctgttttacaatcgtaagcatcatattgcaaaacagcagcacgccgtagaacgcacccgcgaactgtttgccaaaagtttgggctatagcaaaccgcaaacccagggcgattatgctatcgcacagcattttctgacgaacctgcctacagatgctggcgaatatgccgtatttcttcatgcgacgacccgtgatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtgctggccggggctaaatttgtagtgtcggtggatacggggttaagccatttaacggcggcactggatagacccaatatcacggtttatggaccaaccgatccgggattaattggtgggtatgggaagaatcagatggtatgtagggctccaagagaaaatttaattaacctcaacagtcaagcagttttggaaaagttatcatcattataaaggtaaaacatgctaacatcctttaaacttcattcattgaaaccttacactctgaaatcatcaatgattttagagataataacttatatattatgttttttttcaatgataattgcattcgtcgataatactttcagcataaaaatatataatatcactgctatagtttgcttattgtcactaattttacgtggcagacaagaaaattataatataaaaaaccttattcttcccctttctatatttttaataggcttgcttgatttaatttggtattctgcgtttaaagtagataattcgccatttcgtgctacttaccatagttatttaaatactgccaaaatatttatatttggttcttttattgttttcttgacactaactagccagctaaaatcaaaaaaagagagtgtattatacactttgtattctctgtcatttctaattgctggatatgcaatgtatattaatagcattcatgaaaatgaccgcatttcttttggtgtaggaacggcaacaggagcagcatattcaacaatgctaatagggatagttagtggcgttgcgattctttatactaagaaaaatcatccttttttatttttattaaatagttgcgcggtactttatgttctggcgctaacacaaaccagagcaaccctactcctgttccctataatttgtgttgctgcattaatagcttattataataaatcacccaagaaattcacttcctctattgttctactaattgctatattagctagcattgttattatatttaataaaccaatacagaatcgctataatgaagcattaaatgacttaaacagttataccaatgctaatagtgttacttccctaggtgcaagactggcaatgtacgaaattggtttaaatatattcataaagtcacctttttcatttagatcagcagagtcacgcgctgaaagtatgaatttgttagttgcagaacacaataggctaagaggggcattggagttttctaacgtacatctacataatgagataattgaagcagggtcactgaaaggtctgatgggaattttttccacacttttcctctatttttcactattttatatagcatataaaaaacgagctttgggtttgttgatattaacgcttggcattgtggggattggactcagtgatgtgatcatatgggcacgcagcattccaattatcattatatccgctatagtcctcttactcgtcattaataatcgtaacaatacaattaattaagaataaacaagtttaagaagtgagttaaaactcacttcttatctatacaacttaatctctttactgaattagttaaagtttcagtatcgatatcttttaccgtatatgttggggatactatttgtatagatttatgatgattcggggaccaaattaaatgcgagggatattccggagtacgtgaattagggtaaaatgcaagcgttggtttatgataagccgcagcgatatgaacaagagctgtatcaacagaaatgacaaaatcactatacttggtcaacgcaacggtataaataaactcatcaaatggtagtgtttcgatttcaagtattggtattgtcaataaatcttgcggtaacccggtaaatataatccgataattttcaaagtgtgttttcacttcttgatatataacttttatttgctcaaacgtaagacggcatattttttttgcacctaatggattaataatgactattcttgtatctccaataaattcttttattttatcttcaacatctactggtaaatgcaagtcgtagttggtggaaaatttaccctcaccataaatatgcttcagtatttctattgctcgtgtactcatatgttcttttaaacattcatcgtggggatggtaaaatgaatagtaacgcttataccaatgatcaaaacccagaatgtaagaatcttttaaacttgataatattaagctatgcttaaatgagggcatagtttcaaaggggtctaatacaatatcgaactgtaaatcccgcagatgcttacatagagtaagcatttcaagaaaaccggttgattctttaatacagaactcaaatatatttttattattagagagaaattccccaccctttctatttgtgagaagagttattttaacccctttactataaagttcacgataaatcgaacttaatacaattagatcaccaagtttattattatcatgaataataaggcatgatttaacttgtgctggatctgtaatttgattatttattttattacgaaataaaaaagaaaggaaattaatcttgattttgtttatataaaatcttttctttttgtgaaaagttcctaagcgcatttttataccatattattttagtttcaggatgattaattagcataagaatcggttgaagttctatattgcattttttttcttgtcatatcttttgattcttctgcactgatgtcttgaagtttaataaatggaattacatcgtaagaaatagctgtatcatctgataaattataaatattaatatcttttacattatcatgcataaaacgaaaaaatggcaatattttgaataaatccctacttaattccgagggcatgggatttttattctcatcatagaaacgagaacagctacccgttaaatcaagaccagaacaaataatccgcgcatacttaagtgaatatgcgatttgaattgcagcaaaggcaatagtatggcatgagcaataaccaagactaatgtccttgcaaaatccaaccagacgaccttttttagacaacggtacagagatcagcagttctttgtgaatctgtctcaaaatattaaatttaatcttctttataaaaccacctttttcccgacggtaaaaggaccgtaatacgaggcagttctggaggatataaagtttatcttctttggaagcgtgttcataaacgtcaacgtttactatggtataacgacttctctggctaaatttataaaaatcatcacgacgctgatgtaaaaatcggacatctgtaagtacatatataaaaggaacgatattattacttaacagatattgcgcagaaccattgacagcaataatatcctttgttcgtaatactgacaaaggtgttttttgcgatgtagggcccgaaagaaaaataataacatcatcagatattttattttcaatcaggttttcaacatcttttttgtcaatgtatctaatattcttcatgataaacctgtgaaataaataactccgcttaaaactgtcctggtgaagacatgtaattgtgggattttttttagcgcgctggtttccctttcaaacgccgcataaaattgcgcatttttttacgatatactaaaagataatagcctagatctctaatctcatttttaataccgtaatgacgctctaagtcaatacgatctttcgctttacgctgcgctgaagcacgctttccggagagatcgataattcgaacctcaccattttttataatgaagttaccacgatgggggtcgccagaaaccatgccatgttgatgtaaggcattaattgattgctgaattttattttttagcgcatcatcaatatcgggcatatcacacaactctatgccatcaatatactcgatgatcatgatataagtatggacaaaacgtaaggttttccgttcagccaataaataaaagtcattgagtgtatttaacccttcatttcgtactttttgggtttgctcaaaaaggcgttcgtaataatcaccttttaacagagacttaaagaaacgttcgttacgcttaactttcggagaaaaaaccttaagaatcaatttaccgtaatcggtatcaataagcataacttttgtatcatcaatagaacgaaaaaccttgatgatatttatattataagacaagaagtcatttaatacattgaggtactttgaattgttttcatcggtaaaaacaaccaagtctttgatcttgctcttctgaatcataataaaccagttaaatgttatttacggtaatattttcggcaaagataacagactcctgctataattcctgagatataatgatgttgcactaaaagatgtttatatctttttttaaattcaataattgatttcgcatctcgtggagagtcatctttccagggggaattttctaaagctattttatagtattttaccgatggataaattgcccatttgtgccacggtttagttgcacctgtataatgaataagaagagtactttctgtaatcagctttttatagttttgatgtgttttgtcttttaattcacttttaattgtataaattgtattgtactcacgaggcaaaaataatgtcatccctttcagtaagacattcataacatcctgatcagggtatttataaacattatctttactcataagaatagacaacgctttttctgttagttttgcgtcagcccatttttttaagtctaaataaacgacaccggaattaaagtactgcccaagtaattcaggatcagacaacctggataccgccttttcttgcattggctcaacatctttaacaacagcagcaaccgctccatttaaacccagatgtaatagttggctaatatcgcctttacaaacaacatctgcatcaagataaagcaaacgatcaagcgttaaacccaataattgaaatgcaaataaacggaagtacattgctcttgaccagacctgtgtacaaggcaagcactggagcttatcagtgttaattctatataacgtgattcttaattggttttgctctgcaagctttgcaattttttgaaaaaaaccatcattataaacatcagcaataatataaaaatcaagattaatatgtcgattatttaggacaattgatgtgatggaaacacctacaccatcaagataattagcatcgacaccataggcaacatttaaacattcagaagtatttatattagctagccgaaaatcccaggctttaactttatctatctctatggcaggaaatgagtccacaatgctacccttatatcattactttatagtttcccagttttaatgctttatcttttcaataaaataaaaaagatagttgctaaatccttttagatatctatgctttttaagcatatgttttgcgctatatcttaattgattgctattgttcggtttcagcaacgccgtattcttccatggcgaagcattttttgcctccataaaggcttgtgatacaggataatcccaggcccaatcatgccagggcttggttggcccgatataatggataaaaatagtatcgttggttactgggtttataaagctttctttgagttgataatttaagctgaactgggtgttatatttaatatcagcgaaaataagtttatccgccagcaacatatttaacacatcctgatcaggatgtgttatttttttgattatttctggctcatttagcattgcaatagctcgtgcagaaacctgctgagccgcccattgggcagtattaatcaataaaaaaccggagttaaagtaacctttagcaattcccgcaacacctaacgaatgggcgcgtttttcccaccagtcagcttgcccttctgtaacaaccattgcgactttatcgtcaggaaatgagaaattaattagtggctcaatagtcccctgacaaatgatatctgcatccagataaaggactttaggcgccttattaataaagtaatctgcaataacaaaacgaaaatatattgcatgagtccaattcttagtgctaggcaatgagcgcagtcgatcaccattaatcagatatattttaattctggttttatactgcaacgccagggcatcaaaatacttacgatcatcatcaccaaaataatcagtaaaaatatggaaacacaatcgacttccttcattatattttaatattgaagcaatcgaaattccgcaaccaaatagaaagtttttgtcagttccataagcgatgtccagacaaagattttctgtttctactttatgatcataatcaataactgaattaagaaactcagtttcctggaaaaacacctgctgcattatttcctccgggaaatagcagaaataattaccttatgtaatctatcgtaatacttcgattggtaaaattcatcgatcgacgcaggaattttttcatgttcgatatgaatttcacctgctatatatttatttagaagagttacaaaaccagcaatatctcccggttgatacagatggccattgacatcaggttgaataatgtcagcaggcccggagacacaatcggcactgatacaaggaatcccccacgacaaggcttcaagtagggtcattgggaaaccttcaaaagatgacgtgagcaataacgcactcactttttcaatatcttgctggaccaattcccagggatattgttgccaaccataccagacaattcgatcatcaatatttaattctctaccataagcctggcatttttcgaaatcggagccatcacccaatacatggagtttccagttacctttcgcttgtgataagccatcaagcaggtctttaactcttttctggccttcaaatttcatacgcccaacataaataaacgttgccgtttcaccttcctcgggcgcgggaatgactgagtctttagtttcgacgggattaaaaataacatttatcgtcgattctgctacacctcgattaatcatttgctgtttaatgccagagctgattgctaaatgatagtcggcacaggtgatatattcagcatgttttttgtgatctaaagaaaaatgtggccatgaaaatactggcatatcaattcctgattttttacgtgcttttgcggcaaacaggcaggagatcacatcaatacaaataacgatatctggttggtactcctgaagccatttacttagagcatgaatatgtttcgcccgacgcaaaaaacctaaacgaatattggaaaatgaacatgagtatttaataccttccagccatcccttatccattttgtcattacgacaaaagaaaaacatttcactttggatatgttgttgcctgaaggtagtaataacatcacggatgacagtttccatgccgccaaatccagaaacagcttcgccgataaacgctattttcatagaaactctcattaattgagtaaaactcactgttttaacggttttatttgtctataaaatcagaaacaatcgttgacatcattttatctggactgaatttatataaactatcataatccattggtttaacagatgagttaataaaatactctaacttatcccaatcatcatgacctattataaaaaagcgagattcactatagatttctgaaccaaatacatttatattattagtaattaattttttattgaaaaatagtgcctcaagtatacgaagagtccagccagattggttttctttggttatatcaacaattatattagcatttaatgttcttctaatattctcttcataagatatttgtttttcaatcaaatactttgaagtcgtagatgatgtcttatctttgacaacattaaaatctagcttacatcctagtgttgttaatctctcggctaactcattaattatttgaagacgccctttatcacgaccaaggaaaaaacatattggctggctgttatttttgtcagataaactataatttctaatttcatccattcctataggaaaaaattgttctattgccttgatcttttcattccctataaatctatgctcaaaatcatatataatatcgaaataattcgcgttatcaagaataaaatcttcgccaacagtatttcttagaagcaaaactttatgacagttaatattttttaatatttgtttattgatacctttattaacaacactgtcattaatgataattatgtcatcttttttaatatcattgaggtaatgcttgatgaataatcgccccagccatgcattatccatccctatttttgatatttttttattaatccagttatatttttttggtgttgttatattttttatcttgtacttttttttcaggtactgaatcatttttaattcataatctgcaacccaatttataaaataaatagtcataataaagttagttccagtacatactaataaatatttttataatcctttgcgttgtgttcgctctttaatacgctcggccttaacgcttgccatgttcaataaattctgttcaagagacaatattttgcgtaaaggcatcccaaaataaaccttcataaatcgccagatatctctttgcgtcaggccaatattcattgatgagaaatataaaccaatcaggtctttatcgcgccagcggcgcggtacttttgcacgtatctgtgcccgatgcagatcgataactgaaatttttaattcatcttcccggccagtaaatggcaaatgaagcaaaaagtggcaaatgtaacagtcgcggtgatttatccctgcagtatgcattttacgcaccatagttgctacacgtgcgatcagcatacgcttaacacgtatatcaggcgggttgactgcccaatcggcacaataatcttcaaggctaattgtgggagtgagatcttcggtaataataaatgatgcgcgagttaatggatttaaccctttttcgccaaacccaatgcccttcattgtatcaacgccaacatcactcaggcgatgaatagcgtgccactctctgtctgcgcccaaaacgggcatccgcaatgagagtagattttttataatctcttttaatgtcgtccccttgtgccatttaagaaaatagcttttcccggacagttcaaagcgtaatgtacgacgagtctccagttcacgaaagacctcgccgttcagttttttgacctctgcaaaagcatctttaccacgccaaagtgtggcaagcggctcttttaattcaaccatctaaaccacctgtaatgatatccgcggctttttctggcaagctatacaaatcctgagtatcggcataatggcgagcattctccgcccaggccattcgcaatggcgactgagttaacgctttacgtaaaacttcatttaattgttcctgagagaaaggttcagcgatgaccgttccacaattggcatccgcaatataatgcgcgtacccacataccgctgttgttaaaacaggtaacccagcagtgatcgcttctagaagaacgatacccgcggcttcctgataagcgggatgcagtaataaatcagcggctgccattaattctgacacatcattgcgaccggagaagaaatgcacattgctccgcacgccgagtttttctgccagcgcttcaaattttcgcggcttatcctgaccaacaacaaataaaagcgtattgtgacgtaatgattccggtaacgatgccaaagcttcaattgagcgatctacacctttacggccaaaatctgatccaacctgcagtaataagttttgttgctcttttatgccatttttctggcgataaatttcacggctgtttgggatttgctcactgtattttctgtccggataaataccgggaggaagaatttgaaaacgttcaggttcagtttgataatgcttctggaaatcggcgatttgcttatcggtcagcatcataagtttcgtcgatttaccctgctcgaaagtcgctcgctcaaatgcggcataatggcgatatcgtgatgttaaacgatataaaaaacctttttcttgcgcaactttctcggcgtaacaaacatcagcggcaaaataaacatccaggccaggcatcttattaaacccaacaacgcgatctgcgggatgctctttgagatgattttgtacccaggcataatattctgcattgcgtccatggttggtatgggacttaactggcacctgaataagctcaaatgctttcgggcaatcgccttcccacgactgtgtatatacccgaacatggtggccccgtgcggcaactgttgatgcaatgcgcataaagtcacgttgaagcccaccaaatggaaaatatttatataaacaaaacgccacgatcataattgtgcattcctgtcagctgaaggggcatcttctggcaacagcttttccgtagcggcgatcacatcctccgctgggataacagaaagatattttttgttgcggtcaagttcatgccgggtcggcattttctgataattccccgcccagaattgaataatattctcggtccagggacgccagaatacgtgatccgttgcaccaaatagactaatgactggcgttttcactgccgctgcaatatgtcccggcgcagaatccacaccaataaaaagcactgcatgatcaattaatgcacccagttcaggaaaacgtgttttacctgcaaggccagtaatgggttttgtttcgcaacctcgtgcaatctcatctacacaagcgagatcatctgccgagggcccacaggttagcacaacctgatagcctcgctgttgcagcgcatcgataaccttagaaaatttatcgttatcccaacacttaaatatctgacgcgctgtcggttggatgacaacataatgatcttttacgcccagggcatctaattcccggcgcatcttcttccagcaatcttcggcgtaactcattgttgtgtcggtgtagaaatcggtaatacctaatggctcaaggaccgataaattacgctcaacaatatgtgtaccgtgtattggcgctaagtgtgtgaagctttttttccaaataccatgctgccgatgaccataaagttgcgatattttcatccgtgcaggtaaacaacgtaccagcagcgccaccatccactgatccgtaagattaatgaccaggtcataattattcgcacgcagagtttttatcaacgaaagcacatttttaattttatcgaaagttcccgcacctttattgcttatcccatagagcgcattaatttccgggttttcagacaaaatagggatggtgtcctgataaagcagcatatcgatttttgcatcaggataattctgcttgagcgtactgatgacaggagtagttaataacatatccccatgatatcgcatctttatgaccaggatttttcgaaatggcttttccactagcgactcttttgtgtgattgtctggttaagttaagcagaaaaaagcacgctaccgccccaggctcaacagctacctgaatactgataacgcacttactttgacgtgctagtgtatcatttctttcgcagcaatccgacccgaatgatttttatacacaaaatatactttaatcataaaaatcaaatagataaaaaatagcatttcgataatgtcagtacggcctatgtagatttgaaaatggggccgagtttcaatgaatcgcataaaaatacaaaaaaaatgaagatgtagcggcagatcagaccaaactgaagctatttaagtcaaaaacgggaaaagtaatggtaaagccacagctaaatacatagaatccccagcacatccataagtcagctatttactatgctcgaattgctttacaccgcccttctctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcaatcccgttggtgcgcgcgctgcgtcatcgttatcctgatttaccgattaccgtaacaaccatgacgccaaccggttcggagcgcgtacaatcggctttcgggaaggatgttcagcacgtttatctgccgtatgatctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgtcgcttgctgcgtcgtattacgctgattgctgcgcaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcacgaaggcgaagagagtgtggtgatcgccgcacatcaggcattgttacagcaattcccgaatttattgctcatcctggtaccccgtcatccggaacgcttcccggatgcgattaaccttgtccgccaggctggactaagctatatcacacgctcttcaggggaagtcccctccaccagcacgcaggttgtggttggcgatacgatgggcgagttgatgttactgtatggcattgccgatctcgcctttgttggcggttcactggttgaacgtggtgggcataatccgctggaagctgccgcacacgctattccggtattgatggggccgcatacttttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtactgtatcaaaaccagggcgcgctacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcagatgttcgatcacgttattctggcgattgccgccagccccagtaaaaaaccgatgtttaccctggaagagcgtgtggcactggcacagcaggcaaccgcgcatctggggaacgtggaagtggtcgggtttagtgatttaatggcgaacttcgcccgtaatcaacacgctacggtgctgattcgtggcctgcgtgcggtggcagattttgaatatgaaatgcagctggcgcatatgaatcgccacttaatgccggaactggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagcgtttatgccggatggtatgccatccggcgcgcatgaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccaccctgctcaatcgaacgcagcaacaccgctttaatcacccgagctaacaattcacactctgccagcgacagtgatgacgccagccgatccggatggatccccgccgcaaacagtgattcgctggcatagatattccctacccctaccaccagcttgttatccatcagccacggtttaatcgccgtttttttcttcgcgcacttctgatgcagatactcaccattgaaatcgtcgctaagcggctccggtccaagatgggtcagcacattatgcccttccagctctttggtccacagccaggcaccaaagcggcgcggatcggtgtagcgcagcactttgccgttgctcatcaccaaatccacatggtcatgcttttcagggggaagttcttctggaaggatgcgcaggctgccagacatccctaaatgaatgataatccagccctcaggcagctccagcagcagatatttagcccgccgctgcacgctaagcactggttggtcgcttaaacggtagatctcttctgaaaccggccagcgcaagcgtccgttgcgcaccactgcatgaagaatggttgcaccaacgagatgcggttctatgccgcggcggctggtttcaacttcgggtaattcaggcatagcatctccaggaatgaacagatgcagtcaatatgggggcaagcagataacaaaaaaccccgccggagcgaggttttttgttacatcaaagcgagaattatttgattttcgcttctttgtagatcacgtgctggcgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgtgcaaggatcagcgccgaggcgtttatttttatcgcttcgcggataatttcccgaggatggacttcaacatggtttagcgtgccggaaaaaagacgcctatgcgttataacccggtgttgggagtcgagaaagatcaccataaagatctcccgctcctcacccgtgagctggctttgtaaaaattccctcgtcatctccgggctgagtaaagggctttcttcacgcatccgcacgttgtagtaacgccgcgccagttcagcaatcccctttaactgggcaaatttcgccacgccaattccatgaacgccactaaattgttcatattcagaggttaacaagccataaagagagccgaaattctccagcatctcttttgccagggttaatacatctttaccgcgcgttccggtacgcagaaatagcgccagcagctcgacatccgttaaggcgctaataccaaacttcagcattttttcgcgcggcatcaacagctgtgaattgtttttcaccttcacctcctttgtggtgctcgcatcctgtcatagccgtttcgttaaatcgacggccagttttcaatcctggaaagcgcctcgcaaagtgaatctcaggtgaaggcacgacaacaaaagtattgtgataaaatcgccaacttctggtgtcaccctacaggaaaaatcatcatgagcctggccggtaaaaaaatcgttctcggcgttagcggcggtattgctgcctataaaacccctgaactggtgcgtcgtttgcgcgatcgcggggccgacgtccgcgtagccatgaccgaagcggcaaaagcctttatcaccccacttagcttgcaggcggtttctggttatcccgtttccgacagtctgctggacccggcagccgaagccgctatgggccatattgagctgggtaaatgggctgatttagtgattctcgcccctgccacggcagatttgattgcccgtgttgctgccggaatggcgaatgacctggtatcgacgatttgtctggctacacctgcgcctgtagccgtgctccccgccatgaaccagcagatgtaccgtgccgctgccacgcagcataatttagaggtgcttgcttcccgtggtttgctcatctgggggccagacagtggcagtcaggcttgtggtgatatcggtcctgggcgaatgctcgatccgttaaccattgtggatatggcggtagcgcatttttcgcccgtcaacgacctgaaacatctgaacattatgattaccgccggcccgacgcgtgaaccgctcgatccggtgcgttatatctctaatcacagctccggcaagatgggttttgctatcgccgccgccgctgcccgtcgtggcgcgaacgtcacgctggtatcaggtccggtttcactaccgacgccaccgtttgttaaacgtgttgatgtgatgaccgcgctggaaatggaagccgccgtgaatgcttctgtacagcagcaaaatatttttatcggctgcgccgccgtggcggattatcgcgcagctaccgtggccccagagaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcaacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacagcttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaacctgattctgaaagatgagaaagacaccacagcgcgcctgcgtctgattgtgttgctgcttctcggttttggtgagcgtaatcctggcctgacccgcatcctcactggtcatgcgctaatgtttgaacaggatcgcctgcaagggcgcatcaaccagctgttcgagcgtattgaagcgcagctgcgccaggtattgcgtgaaaagagaatgcgtgagggtgaaggttacaccaccgatgaaaccctgctggcaagccagatcctggccttctgtgaaggtatgctgtcacgttttgtccgcagcgaatttaaataccgcccgacggatgattttgacgcccgctggccgctaattgcggcacagttgcagtaatatgacgccggatgacttttcatccggcgagtttctttaaacgccaaactcttcgcgataggccttaaccgccgccagatgttccgccatttccggcttctcttccaggtaagcaatcaggtctttcagggtgatgatagagatcactttgcagttgtaatcacgctcaacttcctgaatcgccgaaatctcgccgcgcccgcgttcctgacgatcgagcgaaatcaacacgccagcaagcgtcgcgccattggcctgaataatctccatcgactcgcgaatcgccgttccggcggtgatcacatcatctaccagcattacgcgtccttgtaacgcgctaccaaccagattgccgccttcaccgtggtcttttgcttctttgcggttaaagcagtacggcaggtccaggtcgtgatgctccgccagtgccacagcggttgtggtggcaatcgggatccctttgtaagcagggccaaacagcagatcgaactcaatgccggaatccaccaacgcttcagcgtaaaaacggcctaacagtgccagatcgcgcccggtattaaacagcccggcgttgaagaaataggggcttttgcgcccggatttcagcgtaaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattcccctcgggccagagccaacaagatgagtagctcttcatgggtgaacggctcgccttctgccgtcccctgcacttcaatgatgcgcccgtcttcggtcatcactacgttcatgtcggtctctgcggcagagtcttcaacgtattccagatcgcaaaccgcttcgccgttcacaattccgacagaaactgcggctaccatccctttcatcggattggttttcagcttgccgttttccaccagcttctgtagcgcatctaccagcgccacgcaggcacccgtaatcgacgcggtacgcgtgccaccatcagcctgaagcacgtcgcagtccagcgtaatggtgaactcacccagcgctttcaaatctactgccgcgcgaagagcacgggcgatcagacgctggatttccattgtgcgtccaccctgcttacctttcgccgcttcacgagcgttacgggtgtgggtagaacgtggcagcatgccgtactctgcggtgatccagccctggccctgacctttcaggaagcgcggcacgccttcttcaatagaggcggtacacaacactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagtgacgaaggggaaatcaacccggttgatattctacgctggccgggcgtgatggcagcccaggagcaggatcttgacgccattgccgctgaaattctcgcggcgctggatggtacgctggacgactttattgtcgcgcgcgaaaccgaaggtcaggcactgaaagcattgatcgagcagcgtctggaaggcgtcaccgccgaagtggtcaaagtccgctcccatatgccggaaatcctgcaatggcagcgtgagcgtctggtcgcgaagctggaagatgctcaggtgcaactggaaaacaaccgtctggagcaggaactggttctgctggcacaacgaattgacgttgccgaagaactggatcgcctcgaagcgcatgtcaaagagacctacaacattctgaagaaaaaagaagcggttggtcgtcgtctggattttatgatgcaggagttcaaccgcgagtcgaacactcttgcgtcgaagtctatcaatgccgaagtgacaaactccgccatcgagctgaaagtgttgattgagcagatgcgcgagcagattcagaacatcgaataactcgtaacgccaattcttacttttccgccttcacaaatgccgccactcaaacagagcggcatttttcttccccgcaacattcaattctgttttgcgtgcctgctccagattttgcgatgtttttttgcccagcacactgagaacgtgagatactcacaactgtatataaatacagttacagatttactttctttgcaattgatatcacatggagtgggcaatgaacgaacatcatcaaccttttgaagagataaaactgattaatgcaaacggagcagaacaatggtcagcaagacaacttgggaaactactgggttattcagagtatcgtcactttatacctgtattaacgcgcgccaaagaagcctgtgagaacagtggtcacacaattgatgaccatttcgaggagatcctcgatatggtcaaaattggctcaaatgccaaaagagcattaaaagacatcgtactctcccgctatgcctgttacctggtagtacaaaacggcgaccctgcgaaaccggtcattgcggcagggcagacttattttgctatccagacccgacggcaggagcttgctgacgatgaagcatttaagcaacttcgtgaagacgaaaagcgtctgtttctgagaaatgagttgaaagaacataacaaacaattggttgaggcagcacagcaagctggggtagcgacagctactgatttcgccatatttcagaatcatggttaccaggggctgtatggtggattagatcagaaagctattcatcagcggaaggggctgaaaaagaatcagaagatcctggatcatatgggttcaacagaactggcggctaatctctttcgagctacccaaacagaagaaaaactcaagcgggatggcgtgaattcaaaacagcaagcaaacaccacacactttgacgtgggtcgcaaggtgaggcaaaccattcaggaacttggcggaaccatgcctgaggagttgccgaccccgcaggtcagcatcaagcagttggaaaacagtgtaaaaattacagagaagaaatagcagaaactaaaaactctttttgttgattgagacacccgatgcgtaagccaaggtccaggtgcagtgaacacaatggctaaatattgcacctttcttttccccctcagttttaacctattttttcttatgcattttctcagacaagaagtcagaagaatgcatctctgctacagaaaatagcgatttcacataactacaagttatcaatttcccctccccttaaaaaatctcaatcgtgacaatgcgcacaaatcgctaccctgccagacagatttttagggagagaaccatgctgttacacattttgtatttggttggcattactgccgaagccatgacgggggcgctggcggccggacgacggcgcatggatacatttggcgtaattattattgcgaccgccaccgcaattggcggagggtcagtgcgcgatattctgctgggccactatccgctcggctgggtcaaacacccggaatatgtgattatcgtcgctaccgccgcagtactcaccactatcgttgctcctgtaatgccttacctgcgcaaagtgtttctggtgctcgatgcgctcggactggtggtcttttctatcatcggggcacaggttgcactggatatggggcacggcccaattattgccgttgtcgcggcggtaaccaccggcgtgtttggcggcgttttgcgcgatatgttctgtaaacgtatcccactggtattccagaaagagttgtatgccggtgtctcatttgcctccgccgtgctgtacatcgcgctgcaacactatgtttctaaccatgatgtggtaattatctccaccctggtattcggcttttttgcccgcttactggcgctacgccttaagctgggattaccggtcttttactacagccacgaaggacactaaggttcaaaacctgtgatctgctgggcagccagccaactgcccagcttcttgatttgcgcattttccttccattcaataacctgtctggcgcgtcccgatccagtccccggcagctgctgccagaactgctccgtgctaaataaaagttgcgaccaggaccgttcatcactggcattaagcgccgcccgggttagcggtattcccattgccatcacccagcgagtaaaaggctgcttacgagccagattaaactgatgccatagctgcgcacttttacttttcgcgatccccggcgtgttctgtaattgctctggcgttaataaaagccaggaaaagatatgttcaaagcgatgagtctgatgcagcgcgcgccaaccggcctcaccaatgccatccagcccaagaacctgttttgcccccagccagactaagcgtgaaatgaactgttcctgacaaacatcagaagcaaagtagcaggtcaacgagttaaagcggttttctggcggtgtcggttttgtacgttctgcaccgcgccacaccacatcatcaatgcgaggaataccctgaccggcaaggctgacgagaatctgatcaccaggcgcaatatcccactcctgccagcgcctgacggaaccaatattcacccgctggacttttttatcatccagcatgacaggtgcgagtgacgcaaccaccgatattttaccgctcttacccaccgcaaactgaattgccttcacttcggcaacctgagctacaggttgatatttccaggccaccagccactctgcctggcccggtagccaatggcgggattctggctctttcgccgctcgtacaactacgccatcggtgacgaagggtaattccgctttccaccactcattgcgtacgcgcgcaacttcatcagcatttttcaccgcacgggtatacgtctgcgttagagtaaaacctgcggtagccagctcttttaaacgatcagacattaactgcggtccatccggccatgcccagacaaaaacgcccagagaattcagcgtgtcgctatcgtcctggcgcatcatcaagccagcaacttttgcgcgggcatttattccccccatttgttgttggatatgcccctcgcgctggagaaatatttccccctgaagcgtactgttggctaaaggcccgctaacggtttgcggcacagcggaaattaagctaactttctgcgtccagtcctcgcctttcaggccattaccgcgactgattgctttgttcagtttcccgtcccgataaaccagggttaccgcaacgccatcaacttttggctgcacccaaagatcgctacgttctcgcatccacagacttaatgcgtttttatccaccattttgcgtacacccgtatgggcaaccggatgcataaccgcaccatttaaaggcggcatcatcacgtcgcggggctcgctcccaaagcagcgttgccactgcgtaagacgggcgcttaactgatcgtaaacaccgtcttccacctcactttttccttccttccagtagtcatcgtcccactgttttatttgctgttgcaggcgggaaatttcttcctgtgctctggctggcgaccaggccggacagaccgcccacacagatgattgccagcacaagatacctattaatatcgccatccatactttcatcatcacctccgctgtagatagtcaggcagatatacaacgtgatgaaagcaaagccgagtggcaaaaacggagtctgcgaggacgcttcctgaaaatcgtctttattgcagtgaatgacaggcaaatgcggaagcagctacgcaaaacgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagcagagatgcgttcctcgaacacgcagaagtttttggtaattactatggcacttcgcgtgaggccattgagcaagtactggcgaccggtgtcgatgtttttctcgatatcgactggcagggcgcgcagcaaattcgccagaagatgccgcacgcgcggagtatctttattttaccgccgtccaaaattgaactggaccgccgtctacgcggtcgcggtcaggacagcgaagaggtcattgcaaagcgtatggcgcaagctgttgcagaaatgagccattacgccgaatatgattatctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcaactgattcaaacctacctgccggaagaccaaatcaagcgtctgcggcaggcgtatctcgttgcacgtgatgctcacgaggggcaaacacgttcaagcggtgaaccctatatcacgcacccggtagcggttgcctgcattctggccgagatgaaactcgactatgaaacgctgatggcggcgctgctgcatgacgtgattgaagatactcccgccacctaccaggatatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcatcctcatcaaacttgccgaccgtacccacaacatgcgcacgctgggctcacttcgcccggacaaacgtcgccgcatcgcccgtgaaactctcgaaatttatagcccgctggcgcaccgtttaggtatccaccacattaaaaccgaactcgaagagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgagaagcatctttattcgatttactgcaaaatggtgctcaaagagcagcgttttcactcgatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgatcggcccgcacggtgtgccggttgaggtccagatccgtaccgaagatatggaccagatggcggagatgggtgttgccgcgcactgggcttataaagagcacggcgaaaccagtactaccgcacaaatccgcgcccagcgctggatgcaaagcctgctggagctgcaacagagcgccggtagttcgtttgaatttatcgagagcgttaaatccgatctcttcccggatgagatttacgttttcacaccggaagggcgcattgtcgagctgcctgccggtgcaacgcccgtcgacttcgcttatgcagtgcataccgatatcggtcatgcctgcgtgggcgcacgcgttgaccgccagccttacccgctgtcgcagccgcttaccagcggtcaaaccgttgaaatcattaccgctccgggcgctcgcccgaatgccgcttggctgaactttgtcgttagctcgaaagcgcgcgccaaaattcgtcagttgctgaaaaacctcaagcgtgatgattctgtaagcctgggccgtcgtctgctcaaccatgctttgggtggtagccgtaagctgaatgaaatcccgcaggaaaatattcagcgcgagctggatcgcatgaagctggcaacgcttgacgatctgctggcagaaatcggacttggtaacgcaatgagcgtggtggtcgcgaaaaatctgcaacatggggacgcctccattccaccggcaacccaaagccacggacatctgcccattaaaggtgccgatggcgtgctgatcacctttgcgaaatgctgccgccctattcctggcgacccgattatcgcccacgtcagccccggtaaaggtctggtgatccaccatgaatcctgccgtaatatccgtggctaccagaaagagccagagaagtttatggctgtggaatgggataaagagacggcgcaggagttcatcaccgaaatcaaggtggagatgttcaatcatcagggtgcgctggcaaacctgacggcggcaattaacaccacgacttcgaatattcaaagtttgaatacggaagagaaagatggtcgcgtctacagcgcctttattcgtctgaccgctcgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcacgccgtctggcctggtagccgcatgcgcaccatggcttcggcagcggcgggtagtaacagctgggtacaggtgaaaacacaccgcaccattggcgatgccgtcgctcatctcaaaggccagggcatgcagattctggcaacccatctttctgataacgctgtcgatttccgcgaaattgattacactcgcccgacctgcattttgatgggacaggagaaaacgggcatcacgcaggaagcattggccctggcggatcaggacatcatcattccgatgatcggcatggtgcagtcgctgaatgtttccgttgcctcagccctcattctttacgaagcccagcgtcagcggcaaaatgcaggcatgtacctgcgtgaaaacagcatgttgccggaagcagagcaacaacgcctgttgtttgaaggcggctatccggtgctggcgaaagtcgcaaaacgcaaaggcctgccttatccccacgtcaatcagcaaggcgagatcgaagctgatgccgactggtgggctactatgcaggctgcagggtaagtgccatgaaaggtcgcctgttagatgctgtcccactcagttccctaacgggcgttggcgcagcacttagtaacaaactggcgaaaatcaacctgcataccgtgcaggatctactcttacaccttcccctgcgctacgaagatcgcacccatctctaccccatcggagaactactgccgggcgtttatgccacggtggaaggcgaagtgctgaactgcaatatctccttcggcggtcggcggatgatgacctgccagatcagcgacggttccggcatcctcaccatgcgctttttcaatttcagcgcggcaatgaaaaatagcctggcggcgggccgccgtgtactggcttatggcgaagcaaagcgcggtaaatatggtgcggagatgatccacccggaataccgcgtgcagggcgatctcagcacgccagaattacaggaaacgctcacgccggtttatccaacaacggaaggcgtaaagcaggccacgctgcgtaaattaaccgaccaggcgctggatctgctcgacacctgcgccattgaagaactcctgccgccggaactgtcacaaggaatgatgacgctaccggaagcgttgcgcactttgcaccgcccgccaccgacgctacagcttagcgatctggaaaccgggcagcatccggcgcaacgtcgtctgattctggaagaactgctggcgcacaacctcagcatgttagccttacgtgccggagcacagcgttttcatgcccagccgctgagcgccaatgacacgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgccgccctcgccgcgttgcgtgcgattgcccacggcaaacaggtagcattgatggcaccaaccgaattactcgccgagcagcacgccaataacttccgcaactggtttgcaccgctcggtatcgaagtgggctggctcgccggtaagcagaaaggtaaagcacggctggcacagcaggaagccatcgccagcggtcaggtgcagatgattgtcggtacacacgccatcttccaggaacaggtgcagtttaacggcctggcgctggtgattatcgacgaacagcatcgttttggcgtgcatcagcgtctggcattgtgggagaaaggccagcagcagggcttccatccgcatcagttgatcatgaccgccacgccgatcccccgcacgctggcaatgactgcgtatgccgatctcgatacctcggtgatagatgagctgccgccaggccgcacgccagtgactacggtcgctattcctgatacccgccgtaccgacatcattgaccgcgtgcaccacgcctgcataactgaaggtcgtcaggcatactgggtttgtacgttgattgaagagtcggaattgctggaagcgcaggcggcggaagctacctgggaagagttgaaactggcgctaccagagttgaacgttggcctggtacacgggcggatgaaacctgccgagaaacaggcggtgatggcgtcgtttaaacaaggtgagctacacctgctggttgccacaaccgttattgaagtcggcgttgatgtgcctaacgccagtctgatgattatcgaaaacccggagcgtctgggtctggcgcagttacaccagctgcgcgggcgcgtaggtcgtggcgcggtggcttctcactgcgtgctgctctacaaaacgccgctttctaaaacggcgcaaattcgcctgcaagtgctgcgcgacagtaacgacggttttgtgattgcgcaaaaagatctggagattcgcggccctggcgaattgttaggcacgcgtcagacgggtaatgctgaatttaaagtggcggatttactgcgcgatcaggcgatgatcccggaagttcagcgcctggcacgccatattcacgaacgttacccacaacaggcaaaagccctgatagaacgctggatgccggagacggaacgttactcgaatgcgtaaaaggcggcagtgagaagaccgccatttcaggttaccctaccttcctgccggatgcgattcatcaccctacaaattcaataaattatgaatcaatacgcaggcttgataagcgaagcgtatcaggcatttgtctttgttgcggcggcacttctaccgccgcttcatcggttaaccggcaaaaatcggcaacatcaaatacaacttaattaccagcgcattgacgatatcgataaagaacgcaccgaccatcggcaccaccaaaaacgccatgtgcgacgggccaaagcgttcagtgatcgcctgcatgttggcgattgccgttggcgttgcaccgaggccaaaaccacagtgacccgcagccagcactgccgcatcgtagtttttgcccatcatgcgccaggtaacgaagatggcatacaacgccatgaagatggtctgtaccaccagaatcgccagcatcggcagcgccagcgaagccagctcccacagtttcagccccatcaacgccatcgccaggaacaacgacaagcttacgttacccagcacggataccgcacgctcaaagacgcggtaaaagcccattattgacagaccgttgctcagaatcacgccaacaaacagtacacagacgaaggtcggcagttcaaaagcagtgccagccaaaagttgcgcaacaattttccccaccgtcaggcagatagcaatcagcgcgatagtttcaatcagcaccaacgaggtgatcatgcgtcccacatccggcttttcaaacgccgtcgggacttcctggtcatccggaataccgttcggcgtggtggagtgtttcaccagatagcgcgccaccggaccgccaatcaagccgcccagcaccagaccgaacgttgcacaggccatcgccacttccgtcgcattggtgaagccataacgttcaatgaacaatttactccacgcagcgcccgtaccgtgaccgccggaaagagtaatagaaccggccaacagccccatcagcggatcaagccctaacaagctagccataccaatgccaatggcattttgcatcaccaacagaccaacaaccacaatcaagaagatgccaaccacacgcccaccggcacgcaaactggcaatgttggcgttcaggccaatggtggcgaagaaagccagcattaacggatcgcgcagggacatatcaaagttgacttcccagcccatgctttttttcagtactagtagcgccagcgccaccaacaaaccacccgcaacaggttccggtatggtgtatttcttcaaaaaggagacggaatggaccaacttacgcccgagcagcaacgtcagcgttgcggcaacaagcgttgctaaagtatcgagatgaaacatagttactcctttgtatccgcatcactctttcatactcgtcatacttcatcgcgcagtggcaacttcatgaactatgacgggtatcgagttatgctttcctgggtcaaattctcagctgttaatgaacaaatggcatggattttaagcagaaaaataccaaaagttatataaaaaagtgcatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatctgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggctgttgtctattcagggcaccagcttcaactttgttgccccgctgattatgggcggtaccgcgctgaaaaccggtggtgctgatgttcctaccatgatggcggctttgttcggcacgttgatgctggcaagttgcaccgagatggtgatctcccgcgttctgcatctggcgcgccgcattattacgccgctggtttctggcgttgtggtgatgattatcggcctgtcgctaattcaggttgggttaacgtccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtaattgcgatggcggccggatatgcgctggcgtggtttatgggcatgttgccagaaagcaacgaacctatgacgcaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggcggcgtgctggcaaacggcctgaactcgtttgtttcggcggtgtttaacaccttcccgaactcctgcttcgggcaaaacaacggagtgatccagttgactggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgtcgggcgattctgattatcgcgctgtcgctggcggttggtctgggcgtgtctcagcagccgctgattttgcagtttgcccctgaatggctgaaaaacctgctctcctccgggatcgccgcgggcggtattactgccatcgtgctgaatctgattttcccaccagaaaaacagtaattcactggcggcggtaagataattaccgccgcagtctcacctctttaaccattcccgccttgaggattgcgcgtaaatcgtgcataactcccttatgtgcatttcacgggatggaagaccatgaaatttattgggaagctgcttctctacattctcatcgctctgttagtggcgatcgctggcctctattttcttctgcaaacccgctggggagcagaacatatcagcgcatgggtttccgagaatagcgactatcatctggccttcggggcgatggatcaccgtttttccgcgccatctcatatcgtgctggagaacgtcacgtttggtcgtgatggccagcccgcgaccctggtggccaaaagtgtcgacattgcgctaagcagtcggcaactgaccgaaccacgccatgtcgataccatcctgctggaaaacgggacgctgaatctcaccgaccagaccgcgccgctaccgttcaaagccgatcgtctgcaactgcgtgatatggcgtttaatagcccgaatagcgaatggaaactgagcgcgcagcgggtaaatggcggcgtagttccgtggtcaccaaaagccggtaaagtgctgggtacgaaggcgcagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgccgacggcagctggcaagtggaaaacctgcgcatggcggatatacgtctacaaagcgaaaaatcgctaaccgacttctttgcgccattacgctctgtcccgtcgttgcagattggtcgcctggaagtgatcgatgctcgtttgcaaggtccggactgggcggtgaccgacctcgatctcagcttgcgcaacatgaccttcagtaaagatgactggcagacacaggaaggcaaactgtcgatgaacgctagcgagttcatttatggttcgctgcatttatttgacccgattataaacacggaattttccccgcagggcgtagcgctgcgccagttcaccagccgctgggaagggggtatggtcagaacgtcagggaactggctgcgtgacgggaaaacgttgatccttgatgatgcggcaattgccgggctggaatataccttgccgaaaaactggcaacagttgtggatggaaacgacacccggttggttaaacagcctgcaactgaagagatttagcgccagccgcaatctgatcattgatatcgaccctgacttcccgtggcagctcaccgcgctcgatggttacggtgccaacctgacgctggttaccgatcataaatggggcgtctggagtggctcggcgaatctgaatgccgccgccgcgacattcaatcgtgttgatgttcgtcgcccgtcgctggcgctgaccgccaacagcagcacggtgaatatcagcgaactgagtgcatttactgaaaaaggcattctggaagccaccgccagtgtttcacaaacgccacaacgtcagacacatatcagcctgaatggacgcggtgtgccggtgaatattttgcaacagtggggatggcctgaattaccgttgactggcgacggcaatattcagcttaccgccagtggcgatattcaggccaatgtcccgttgaaacctacggttagcgggcaattgcatgccgtgaacgccgcaaagcagcaagtgactcaaaccatgaatgctggcatcgtttccagcggtgaagttacatcgacggagccggtgcggtaaacatcaatctcgccgggtacgactcagacgtacccggcattccatcaatagattacaacgtaattgtcagcgcattcccttgaggcttcaccaccagcccctgctcactttcagcctgcgaaccgtcttgcagaccatttactttcacaacattgcgcaggcacagtgtccagttcttcgcctcgcccgcaccagtcacagtaatcgtgttgccagtacgtgctgcttttaaagtaaagatcaccgatccgtcagcagcgggcacttcacagacggcttcatgcccgtcttgcagattgaagaggtggaatgccgtgccttcgtgccacacgtaatcgggacgttgatcgttgttgcccagcgccagtagagtgttatcacgcacataaacgggcagactcaggaagccgtgctgctgtttatgccagcgactaccgtcgagttcatcgttgtgccacaggtgtgtccagcgaccttccggcaggtagaactgcacatcgcccgcttcagtgaacaccggcgcaaccatcacgttgtcgcctaacatgtattgacggtcaaggtaatcacaagccggatcgtccgggaactccatcatcatggcccgcatcatcggcgtaccccgcgcgttcgcacgcgcagcttcacgatacagatacggcatcatgcggcatttcagttgcgtgaagaagcgcaccacatcacaggactcatcatcgtaggcccacggcacacgataagatttgctaccgtgtaaacggctatggctggagagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacaatcgccaccccagtgtaccgggaatttctgcgcaccgacggaggccgagcgggcaaacaagacagcttcttcctcaccaacggtgtccttgagcacgttccacaccagttcgttgtagatgtacgcataatggttatgcattttctgcggatcggaaccgtcaaaccactgaacatcagttgggatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccatagcgaaccgtccgggcgtttgagtaaatagcctttctcttgtaactctttaaagacgggggatttttgaccgatataggggttaatccagacgcagattttcagtcctttcgctttcaggcggcggatcatcccttccgggtcagggaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacaggccgaaggaccacgcgggcggcagcgccggacgaccagtaaagcgggtataacgatcaagtaccgctttcggcgtcgggccgtcgataacaaagtattcgagatattcactctcaacgctgaactgcactttggagactttctccgatcccacttcaaaagagacacactggggatgattgaccagtaccccataaccacggttagtcatgtagaacgggatatttttatacgcctgttcagtacttgtgccgccgtcccggttccaggtctctaccgtctggccattgcgcaccagggcagtaaagcgctctcccagaccgtaaactgtttcgccaacgccaagatcaagccgctcaaacatataattgcgttgattattcgtgtcctgcacgtagccattatttttcacctgactaccggtaatacgttcgccgttgcgcagaaaatccagtgaccagaactcacctttgctgacacgcgcgcttaagttgccacttttaaactcagcataacgttctgtgttttcgattgtgaccttcacgtcctgcaaaatattgagcggataatgaggaccgttattcagcgccccctgaaaatgctcaatccgcacaccgacaataccttcctgtggggagaaaaagcgcaacgtaaataaaggcgtatcaagctgccaggtacgttcacgcacatcacggggggcagcatagaccaccatttcattatcctgctgttcaacctcgaacacctgaagcgggtgaatcaaattgaggccaggttgaatcaaccagtttccatcgctaattttcattgccgttccttagttctgcacttcttgagaggtgaattgttgctggcaacggcgtttaccctgagccagctgttccataacggttttcagattgtgcgtcgtgagtgagtagtagcgtttagcgataatcgcgctcagcaaataacagatcgccggaacaatcgtgaatagcgcaataatgatgctaatcgtggcgctgttctgcgctttttctgccgcatcatatccgccataagccagcatccagccgataagagcgccgccgaaggccaaccccagtttgagcacaaacagcgtgccagcaaaactgatcccggtcaggcgtttaccattgcaccactcgccgtagtcgacggtatcggacatcattacccactggataggtgtcaccagttgatgcaacacaccaatcacgaagatgaagacaaacatagtgatgctggcctgcatgggaacaaagaacatcgcgaggctaatcactgccagcagggcgttcgtccaccagaagatagtgactttacatttccagtcggtcagaggttttgccagtgcggaaccaatcaggttacccacgcaataagtggtgagaaaagcgacaaacacttccggcgtgcccaaaatccatgtgacgtaatacatcatcgccccaccgcgtacgcacaccgccaggatattgaaaatggttagtaaaccgacaatccgccactggtcgttttgccagatatcacgtaaatcttcccgcatagacgttgttgtaggtggtgcttcaacgcgttctttagtggtgaagaaacaaaatgccagcatcatgaatgccaccacggaaaggaccgcgataccgccctggaaaccgagtggtttattatcaccgccaattaaattaaccagtggcatcatcagaacagtagaaagcatgcctcccgcggtcgccagcacaaaacgccaggattgcagcgagatacgctgagtcgggtcattggtgattacaccacccaatgcgcagtaagggatattgacgacggtataaagtaaggtaagtagggtgtaagtaattgctgcatagatcattttgccgttcatactgagatctggcgtgctataggccagtacacagacgatcccgaatggcagtgcgccaaacagtacccacggacgaaatttaccccagcgagagcgcgttcgatcggccaacaaccccatgcaaggatcggaaatcgcatccagtgcacgagcgaccaaaaacatggttccgacaaaaccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgtgagagcgaatattccgatatctggttattaatttatgattcttgttttatgtgatcgtggtagcgttaattccgctcatatatcattgtaaaatatgggttttatatgaactataatgctttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgacgttctccaaccccttgtaatactgtcaatccagatattttctactgctcaatattcaatcggcttcaggaatacctggtctaaggttttgtgatggacgatgagcggctgaagaatccgcctgtcggttcttctgtcctcgaacgcatccgcgatattcacgccagtatgcgccgtgtttatttgcaggtgatttgcccccctgctgactctcagccaactgtatcgccattaaggtgaagatgttgttttactcgccccagaacacccttttttatacgactattctatttctttaaccgctggcgaaaaaaactgactataaacttcaccaataatcagactgccatcaagattaatttgttcatttaatatatcaaatcaacttgttttatttttactatcaaaaatagctcattgccttactataattaatatataaattcggtaattaattcttaacatgcttttactaataatctcaattgctggccctataatattgcgctagcattgctttctggttgtatcagcgatactcaaaaattcttaatacaatactcattcgactggtacttatttgtaactcagttatattttttcgcccggtgattcagaagaatgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcggactgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttagctcaccagtctgggctaagaaaaatcggcgtggcgcaaacagagccatcctcgccatttttgctatcatgcctgcatacataaacgacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctactgacgctgtcatttgttcatggcgataaaatcttttctattattaacaatcataaagatgccattagcctgctgattttttccgtggttggcgcgctaactgtacagctcacttttttgctaaccatcgaaaaatcgaacgcagccacggcaacggtgctgcaattcctctcaccgacgattatcgtcgcctggttctcactggtgcgtaaatcgcgcccgggcattctggttttctgcgctattttgacatcgctggtcgggacttttttattggtgacacacggtaatccgacgtcattatcgatctctcctgccgcgttgttctggggcattgcctcggcatttgctgctgcattctataccacctatccctcaacgctaattgcccgctatggcacgttaccagtcgtcggctggagtatgctgattggcggtctgattctgttgcctttttatgccagacaaggaacaaactttgtcgttaacggcagtttgattctggcgtttttttatttggtggtcattggtacgtccctgacatttagtctgtacctgaaaggagcacaattaattggcggtccaaaagccagcattttgagctgtgcagaaccattaagtagcgcgctactctctttgctgttgctggggatcacgttcacattaccggactggctgggaacgctgctgattctgtcatcggtgattttgatttcaatggattcccgtcgccgcgccagaaaaataaatcgtccggcgcggcataagtgagaattaccagccaggcaccgcgccaccgttaaaaatggtttctgccgctttagcgacttcgggtgattgataagattgcagaaattccttcacgttttctgcattcttattatcttcccgtgccaccaaaatattcacatacggcgaattcttatcttcaataaatacgctgtcgtgcaccggagaaagcccggtctgctgaatgtaagtggtgctgataatcgctacatcaactttgggatcatccagtacgcgcgggagctgcgccccctcgagttccataatctgcaaatgacgaggattatcggttatatccagcgcggtaggtaataacccttttccctctttcagagtaattagcttctctttttgcaacagtaaaagtgcgcgaccaaggttggtcgggtcgttggggatcgccactgtcgcgccttcttttatttgcgccacggttttgatttttttggaataacccgccatagggaagacaaacgtatttcccaccgctaccagtttataaccatgcgcctgattatcttgttcaagaaagggtcgatgctggaagacattcgcatcaagttcgccatgatttgtcgcatcgttcggtagcaacgaaccgctaaatcctaccagttcaacatcgaggccatatttctcttttgccacctttttagcgacttccgcgacatcttgttctgcgccatttataacgccaactttaatgtgttttgcatcgctgctactctggtcgcaacctgccagcagaattccggccagcaataatgcggcccctgtccgtagatgatgtgttgtcagtttcatttttttatccttttattaatgattacctgactatagcggtaaggtcgctgcggtttaaaaaacgaaacgctatcgataagaataaaaaggaataaaagtggaatataaagtctggcacttcttactgaccacgcaagcgcgtttcgtacagcatgatgagagcgatgaaagcaaactacacttatgcttcattcgatacacatttgtaaaaggttgaatccatgaaaccaacgacactactgcttattttcacttttttcgctatgccaggcatcgtatacgccgagtcgccttttagctcactgcagtccgcaaaagagaaaaccacggtattacaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacagcaacaactactgaccaacgcttctttacctgatatcaggatttcttcattttcacctttgcagtaaccaacaatgcagtcagcaacatcaatgtgccggacaacatcaacggcgaagtcagaccaatattatccagcgcataaccgccgattgccgcgccacaggtattagcaagctgaataaccgccacctgaatagacccggctttttctgcctgatcggccagcgagcgggtgatccacgttgaccagccgacgggaaccaatgcaaaagttagcccccagataatcgccacgccggtagcaacgattttatcgcttccccacaacgtcagtaccaacgcactcacagccagtattaacggcgcgcctgctaaggccagttttaccgaacgtttaagaatgaacgacgaaagcgacgtaccaataaagctggcgataccaaaactcaacagcaccagcgttaagccatccacgccgaatcccgccaggttcatatacaccgggcgaatatacgtgaagaaagcaaactgcccggcgaaagacatgaagatggcgatcatccctgccatcacacccggacgttgtaataagcggaaagtattttgtttctgatgcgagggttcgcctggcagtgaaggcaatgatttgataatccagaaaatacacagcacgcccatcaccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggcaccagacgcatggtcagcgacgccgacatcgcccagaacccgcccagcgccagccccagacaggcacgaccgattaaaagcaaactgaatgagttagcaaaggaaaccagcaagcaggagagcgtcagcaaaacggcaaacaaaataacaacgtagcggcggtcagtagcctgaattgtctgggtaataaacaaactggcaaacattgccacaaaggcggtcacggtcaccgattgcccggcaaccccttccgaaatgcctaaatcctgggccattggcgtcaacaaactgacgggcaaaaactcaacgataatcagacaggcgacacaaaacgccaccgagaaaacggctgaccagttcggtcgggtgatggcatccgcgccgcggttttcggcaataaattcactcatggtgttacccgtggcatgtttcaggggaaaagccgaccactttaacattgaaatgtgtgacgcatttaacgtttttgcaacttttacggtgttgcttgagctggagttaagatcgaaacggaacagggcaaagattaccggatgcggcgtgaacgtcttatccacccgacaggtcaggcgcggtctgtaggctgataagacgaaacggtttcaatgcaaccagtgaacgccctcggcaggctgaaagaacgcgttatagcgcatctgaaaagcattaatatcctgcatttcaggttcggtttcgcgcagaaaacctagcgccagcctgacctgagcgtcggtaatcggcgcggcgaggcgagctttttgtaaaatccgatgccattgcagcaggttctgttcgctaccatcgacaatgacaatttgccagatgagcaacacctgcgcggcgttttgcaggtgcgactcatccggacgatgcaaataacgtaaaaattcgtcaccagctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagctgcgaccaccaccacacacaggttcagatcgcgccagcgcccggtgcatactttcatgatgcagtacgacataaagccgagtgcaatcccttcggtgatcgagaaagtaaagggcatcatcaccgtggtaataaacgcaggcaccgattcggtaaaatcatcccagttaacgcgcgccaggctcgaagtcatcagcacgccaacaaagattaacgctccggcggttgcgtaaggaggaactatcgccaccagcggtgagaagaacataaccaacaggaacataacgccaaccacaaccgcagtcagccccgtgcggccaccgactgccacaccagaagtactttcaatataggcagtaacagacgaggtgccgataaacgcacccgccaccgaactgacgctatcaacatacagcgccttattcatattggggaatttaccgttaccatctattaagcccgctttatcagttacaccaattaatgttcctgatgaatcaaataggttgatcagcataaaggagaaaatgataccggcgagttcaagtgttaacgcgccgctcaaatctacttcaccaatgacgccgctaatatcaggcggaatggaatagacgccgctaaaatgaacatcaccgaaaaataatccacagcaagacgtcaccacaatagaaaccagcaccgcggcatgaaaatgacgtgatgacaacacggttataataaaaaaccctaaaatacctaacaacacgccgtgagaacttaaatcgccaatcatcaccagcgtgtctttattggcgacaataacgccagtattttttaatcccattaaggcgataaataatccaattccgctggtgataccaatacgtaaacttaagggaatgttggagatcatccagtaccggatacgaaacagcgtgagcaaaaatagtccaactgcgccccagaatattgcgcccatcccggtctgccaggagatgcccatcgcccccacgaccacgaaggcaaagaaggcgttcagccccattgccggagccagcgccacgggtaagttagcaaatatccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgaggtagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccgggctgaataccaggaattgttagccgtttcccgtggcgacgctgttgccgattatattattgataatgtctctattctcgacctgatcaatggcggagaaatttccggcccaattgtgattaaaggacgttacattgccggtgttggcgcagaatacactgatgctccggctttgcagcggattgatgctcgcggcgcaacggcggtgccagggtttattgatgctcacctgcatattgaatccagcatgatgacgccggtcacttttgaaaccgctaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgccctggaaggctgcgatgttaacggtgccagttttacccttgaacagatgctcgcctggcgggaccatccgcaggttaccggccttgcagaaatgatggactaccctggcgtaattagcgggcagaatgcgctgctcgataaactggatgcatttcgccacctgacgctggacggtcactgcccgggtttgggtggtaaagaacttaacgcctatattactgcgggtattgaaaactgccacgaaagttatcagctggaagaaggacgccggaaattacaactcggcatgtcgttgatgatccgcgaagggtccgctgcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtgccgctgcatgtggcatatcgcgtcgccagctggtcgacggcgcgccactttggtctgaatcacctcggcttactggcacccggcaagcaggccgatatcgtcctgttgagcgatgcgcgtaaggtcacggtgcagcaggtactggtgaaaggcgagccgattgatgcgcaaaccttacaggcggaagagtcggcgagactggcacaatccgctccgccatatggcaacaccattgcccgccagccagtttccgccagcgactttgccctgcaatttacgcccggaaaacgctatcgggtcattgacgtcatccataacgaattgattacgcactcccactccagcgtctacagcgaaaatggttttgatcgcgatgatgtgagctttattgccgtacttgagcgttacgggcaacggctggctccggcttgtggtttgcttggcggctttggactgaatgaaggtgcgctggctgcgacggtcagccatgacagccataatattgtggtgatcggtcgcagtgccgaagagatggcgctggcggtcaatcaggtgattcaggatggcggcgggctgtgcgtggtacgtaacggccaggtacaaagtcatctgccgttacccattgccgggctgatgagcaccgacacggcgcagtcgctggcggaacaaattgacgccttgaaagccgccgcccgtgaatgcggtccgttacccgatgagccgtttattcagatggcgtttctttctctgccagtgatccccgcgctaaaactaaccagtcaggggctatttgatggcgagaagtttgccttcactacgctggaagtcacggaataataaaaaaagcccggcgtcatgccgggcaaaagtcaccagttacgtttatgccactgtcaactgctgaatttttttctcgcggcggattttgcgttcttccattaccgccactatcgccatcaggcagatacaaccaatcgcggcgatatccagcgcggcgaaggtgcctgcccagccggtaaggccgaataccggcgtcccatcggcaatcattcccagacctaacttggcaaagctgtcaccaatcaggtaagcaaaggtgcctttaataccatcggcagcgccaatcgcttttttaggtacaaagccaacagcagccacaccaatcaacaattgcgggccaaagaccaggaaacccaacgcaaagagagaagccagatagatatattcgttactggcatgttgatacacaccgagcgtggcgataatcagcgccagcgcgatgcaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcgtatacggttgaccactggtcgataccaatacgtaccacatagaggaaaatgttggcgaagcacagcagccagatcactttgtttttcagcacatactcaacaaagatctgccacttggtcatatcggtagattctgtctctttgtcctcttcgctgatctcctcgccgaacagttcttcagctttgccgaggccataagattccggggagtcgctgccgtaacgcaggccgataaaaccgacaatcagcgcgataatcgacgggaagataaacatgccgatgacatggccatcgaacaggtaatttgccccgaacagcgccacacctgctgcgcctgcaccgccaaggttgtgagaaatattccagaaaccgaggaatgtcccgcgtttacgacgcggcgtccatttggtgatggtggagtaactgcacgaaccgccggtactctggaaaaagccgcttaaggcgtagaaggcaatcatcaggaacaggctaaccgagccgctgcccatactggcactgaagcccagcatacaaatagcagagaggatcagcatgaacggcaggaattgtttggtgtttttgccgtcggcgtagtaggaaaccagcgttttacccacgccataagtgatggagaaacccaggccgatcatccccagctgcgtcatgctcaacccgtaggtcgaaatcatatcgttctgcgcgatgttaaagttcttgcgaatcaggtacatcgtcaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttcgcgcggtgtctgggcgttcaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcatcagccacagggagccgactgaaagcaaaattccggcggcgaaaatcaaattcatcggccctcggttgccgttaaacaatttgtccgagccccaaccggctaccagcgcaccgataaatccgcccagttcaaacatcgtcactgccgtattcgccgtgaccagatcgacgcccagtgtctcggacatatacaaattgccccagtcgttgatcgccgcccggaccacatagaccagcacatagcaaaacgaaagcagccagatatacggattcagcaacacatatttggtgaggatctctttacgcgtcaaccctgccccttcttgttgttgagcaatttccagcgcgtcgtgtcgccattcaccgaccgccggtaaacctaacgcctgcgggcgatcgcgtagccgccagcagagaaaaatccccacgactatcgccatacaaccagcaatcatcatcccggcacgccagccgtaatgcagcgcagccgctgccatcacaatgggaatgagtgcgccgccgacgttatgcgccgtgttccataatgcccaccaaccgccgcgctcggtacgtgaataccaggccgttaacagacgcgcacacaccggtgaaccccagccctggaaaaaggcgttcagcacccagagcacggcaaacgcccatagcgacgtcgagaagccaaacagaatgttgataatgcccgtggcgataagccctatccccataaaataacgggcatttgagcgatcgctgacaatgccggagacaaacttcgacacgccataggtaatgtaaaacagggtcgctaacaggccgatatcgctacggctgagcacgccgttagcaaggatttctggtacggcggcgttaaaacttttccgcgtgaagtaaaacagcgcgtaacccagccagatggtcagcagaatatgccgacgccagtagcgatagcgggcatcaatttcatatttatcagtcattaatggcgcatcggcaggcgctttcagaaacggcaacatcatcaaaccttagacatagcgttgaggtagagaaacgctgacacgcgtgccgtgcagacaggaaatgtgtaatgtgccacccagcgccgttacgcgctcgcgcattccggtgaggccaaaaccttgttgcccggaacccggcggcaaaccgctgccatcgtcttcaataaccagcatcaaccgttcatcctgctgccagccttgcagggtgaccgcgctggcatcagcatgtttcacaatgttgttcagcccttcctggcagacacgaaacagcgtcacgcgctggttttcgcttaacgctgattcatcgattcgccattcgagatggctgacaataccgcgcccttccagctccatttcccgcatcagtgagcggatggcctgctccagggtgagatcatccaactggcgcggacgtaaccgacccaacaaacggcgcaccgcgtcgtaaacgcccagcgatagttgttcgatgagctgcccgctctgcttcacgctggcgttatctgccgccagccgctgaacaatgcccgcctgagtacgaatagcagtgatggtctgaccgatatcatcatgcagctcacgcgccacatcacggcgcacgctctcttcggtttccagcaaccgttcagccagatgctgattgcgcgccagttccttttgcagcgactggttaagttcacgcaaccgctggatgccagcgccaagcaacaaccctgtcagactttgcaccagcagcgagagcaataaatccaccggatgatcgcgccaggtttgactggcgatcagcgcgatggcgttcatcaacgtcgcaatcagcgccccttgccaaccatagtgccaggccagcgcgataatcggcagcgccagacagaatggcgtaaagcgcgacagttcgtccggcaatcccaactggagccagagactgataacaaacagcagcaagtaccagaccagatgtcgcccgcgccagttgattggctgagaaaccagtgacggaccgagcggcagccaggtgttattggcgagatagtgccagaacaccagacatatcggggccagcgtcaggccgccagttaaagtcagcaacagcgcattccacgactctttgccgtgccaaagccagggcagcgactgcaacaacgccgccgccgttaacgccgccccctgtaacagcaaggtgcgccagtcacgctgatggcgatagcgcgagatcagcgctacgggcagtaacgtcagtaaactaccgatcatcaataacggaaaatgggttaaaccgaccgcctgcgttagccagtaaatcagcagccactccgcgcccagcaatacgggccagtatccgcgcgggcattgcagcattagccccagacgcagaccaaacggaaataacagcaccgccatatcagggcgctcaaccagatgcaggctgatactccacaggcaaaaccatgcggcagagaagataaaaaagcaggcaataacggtaattaagcgggagaacaacgtcttcatcaccagccatcaaacatgcggcgcgccagctctacgtcgttactgacgcccagtttttccatcagattggcgcgatggacgtgtaccgttttcggtgacaagcccagttcggcggcaatctctttcaccgccattccttgcgccagtttttccgccacctggcgttcacgtttggttagcgggtcctgacgaccggatgccagtttaatggcaatatccggcgtcagataacagccgcccgtggcaaccgtatgcaccgcagcaatgagttcatccgggctacagcgtttggaaagaaagccgcgtgcccccgcgttaagcgcctgctcaaccagcgcaggactgtcgtgaacggagagcataatcgtcgccatacctttcggcagctggcttagcagctccagaccggagatatcgggcatggagatatcgcaaatacacacctgcacaccgcgccccggcagccccgccagcgcctcgcgccccgaaccaaactcggcaactacctgcaaatcaggttccagccccagcagctgcgcaaagccggagcggacgatgaggtgatcgtctataagggcaacggtgatcatggtcttgtcctggcgggtaaaaaaaatacgcgcttaccttaacgataagcgcgatgttgttcaagccttgagcggttactgaaaaaacaccgcgatcttgttaaacatcgtcggatcggactgattacgctgcactttcacgacatcttccagcttatcgatttggcttatcatctgctccagacgctggtcgtcattgaccagtagccagatatggcttttgtcgctgtcctgaatcggcagacaaagaatgccttcaacgttaaaagcgcggcgggcaaaaaggccacaaacgtgggtcattacgcccggatggttgcgaacggtgagctccagaattacgttgtcatgagttgtgttttgcatggcttattcccccaccatttcagtattcgccgcacctggcggcaccatcgggtaaactttttcttcggcatcaatgcgcacatggatcagcgccgggccagggcgattgatgatttcctgcaatgaagcctgcggatcggcttcgttattcaaatcacaggtttcgaggccgaatccggcggcaatctgcataaagttgattttgcccggataggtggcggcaaaaacgccttgctcgtagaacagactctgttgctgatgcaccagccccagcgcttcgttgttcatcagaatgattttgacatccagctgattttcactggcggtcgccatctcctgaatattcatcatcaggctgccgtcgccggagaaacacaacactttgcgatccgggttcgccagcgcagcgccaatcgccgcaggcaggccaaaacccatcgtgcccagcccaccggaggtcagccactggcgtgggcgattgagcggataagcttgcgcggtccacatctgatgctgaccaacgtcggtggtgataattgcattgtcatcgacacaggcggcaacggcgttgatcaggccgtaatggcttaacggatcgcacgctttcgggattggacacggaaactcacgctgcaaatccgctaccaactggtgccactctgcacgcggttgcgcttccaccagcgggatcaactgcgccagcacgtcatcaacatccgcctgaatcgccacgtgcggctgcttgattttacccagctctgcacggtcgatatcgacatgaatgattttggcattcggacagaactgctcggttttgccaatcgcccggtcatcaaaacgcgcaccgagcactatcaacaaatccgcctcctgcaaaatatagttggtgctgcgcacgccgtgcatccccagcatacccagcgacaacggatgcgcttttggcaacatgcccagcgccattaaagtcatggtggtaggcagttgcgctttctccgccagttcacgcacccgtgcgggcgcattgatcacaccgccgcccagataaagcaccgggcgtttggcagcgttaatcatcgccgctgcgtcacgaatgctttcttcgctaaaggcgggggcggcggctttttctgccatagcgggctgtgtttcaatctcaaaaactgccgtttgcacatccttaggaatgtctatccacaccgggcctgggcggcctgattgcgcaatgcggaaggcatcgctcatgacctgcgggagttcttcgatatgtctgaccagatagttgtgtttggtgatggggatagagatgccgtaggtgtccacttcctggaaggcgtcggtgccgatcatcgaggcgggaacctgaccagtgatgcaaatcagcgggatggagtccagccgcgcatcggcaatggcggtcaccaggttagtcgcacccggtccgctacaggccatacagaccgccggtttaccgtcggtgcgcgccattccctgagcgataaagcccgcgccctgttcatgacgggccagaatatggcggatttgcgtgctttggcttaaggcatcgtaaacaggcaggatagaaccgcccggaatgcctgtcacaatcttaatgccctgctgttccaggaaatgaacgataaattctgcgccggtaaagcgcttacgcgtcgatgttgtgcccgaacttgccatgctccagtccttttcttctgggccgactttccgggaggtgcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgagcatggaagtagtcattggggaccttgttggttttgtgtttaacaatatttatacaagcacagctttacaggggagacaatggaaaatttttcagcaagggaaaattgaggggttgatcacgttttgtactgaattgcagataacaaaaaaccccgccggagcgaggtttcgtcagtcgcctgcggctggtaaccgcaaagcacactgtattatgtcaacactgaaagtatacgtgttccgcgcagaacgcgcaatttcggcacgaattttgacgtatttagtgcatagttgagtatcgatcacagtttgcgttttgtccaaatattactgtttatttatacagtaaacttctataatatcactgtacgcaatgtgttatgcgggggccgcatcgttacccggcgcactaagtcctggctgaaacgggtggtgccgtcagcgccttaaccccgcgtgagcacactgtgttatgtcaacaagcacaacgtttctccttgagataccgcgtgcacaacagctggcaacaggcagcggaaaggtacgtcagctggcagtgctcctgaaccacaggagacgcgtatgaacctggtggatatcgccattcttatcctcaaactcattgttgcagcactgcaactgcttgatgctgttctgaaatacctgaagtaattcagattcaagtcgcaccaaaggggagcgggaaaccgctccccttttatatttagcgtgcgggttggtgtcggatgcgatgctgacgcatcttatccgccctaccatctctcccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcaaagaaacgtcaatttgttattgatgttggtattactcgtggccgtcggtcagatggcgcaaaccatttatattccagctattgccgatatggcgcgcgatctcaacgtccgtgaaggggcggtgcagagcgtaatgggcgcttatctgctgacttacggtgtctcacagctgttttatggcccgatttccgaccgcgtgggccgccgaccggtgatcctcgtcggaatgtccatttttatgctggcaacgctggtcgcggtcacgacctccagtttgacggtgttgattgccgccagcgcgatgcaggggatgggcaccggcgttggcggcgtaatggcgcgtactttaccgcgagatttatatgaacggacacagttgcgccatgctaacagcctgttaaacatggggattctcgtcagtccgttgctcgcaccgctaatcggcggtctgctggatacgatgtggaactggcgcgcctgttatctctttttgttggttctttgtgctggtgtgaccttcagtatggcccgctggatgccggaaacgcgtccggtcgatgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcagcgttttttggcgcatggtttgccggacgtcccaataaacgcttctccacgttaatgtggcagtcggttatctgctgcctgctggctggcttgctgatgtggatccccgactggtttggcgtgatgaatgtctggacgctgctcgttcccgccgcgctgttctttttcggtgccgggatgctgtttccgctggcgaccagcggcgcgatggagccgttccccttcctggcgggcacggctggcgcgctggtcggcggtctgcaaaacattggttccggcgtgctggcgtcgctctctgcgatgttgccgcaaaccggtcagggcagcctggggttgttgatgaccttaatgggattgttgatcgtgctgtgctggctgccgctggcgacgcggatgtcgcatcaggggcagcccgtttaagcgcacgtcaccgcagcatcgtcatcagctccatgggagaacgatgctgctttatcagatcacgcatcacccgcatatgcggtgcggagtaagaataaaacgcctgatagcccgcacaaagcacgctgtctggcgtctcctgccgagcgtgcgggcacaggcgatgccagtcgcacgcctggcagtcacagcgcggttgcgggttttcgctgccacaccatttttgtaaggtggcgtcaaaaagctcaatcgagatacgactgatatctgcccgcacccaacactcgaacagggcaattaaaaatttcccccacagctctgctgtcaccgaagcggccgtcagatcgccccggtcatcaaattcaagatagggaatgagctgtacggagcggatgccccgctgtttgaaattgtgataaaaatcggcaggttgcagagcatccttgtactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgagaatgccaatcgaaatccagaataacatgcccgcctggtgccagttgtgtttgatagccaacgccatcaacgcgccgtagcccagcatggtacgaaaccacgccagtgatgtgcgctccggctgcagtcctgggtcggcaatgcgtctggctttgcggctatccggcatacaacaccagtcccataacgatcaccgccacgaccatcaatattaagctaatgattaataagctgttggtgtagggcaggtcctctttcagacgcatcgctttttcattgcgtaaccagcgcaagtagccatacatcgctaacccgccggaaaacagacacaacaacaacgccagcagttcgcgaatgacgggcgtggcgaaatctggcgcaagttgatcaagcccaacccccgccgccagaaatcctagtgcagtacggatccacgccagaaaagtacgctcattagccagcgagaagcggtaatcaggcgcttctccgaggcgggaaattttcattgttgctcctttgcaatttcactaacgctctacctttagcggtttttttaagaatttcgtccgcccgtttcctgatatgcttttgccatccgctacaaggaggtcagatgggtatcatagctcaaaataaaatcagttcattgggcatgctgttcggtgccatcgctttaatgatggggattatccacttttcattcggccctttctccgcaccaccgccaacgtttgaaagcatcgtggcggacaaaacggctgaaattaaaagaggtcttctcgccggaataaaaggcgaaaaaattaccaccgtggagaaaaaagaggacgtagatgtcgataaaatcctcaatcaaagcggtatcgcactggccattgctgcgctactttgcgcatttattggcggtatgcgtaaggaaaatcgctggggcattcgcggcgcgctggtttttggcggcgggacgctggctttccataccttgctttttggtatcggcatcgtgtgcagcattttgctgatattccttatcttttccttcctgaccggcggttcactggtttaagcagcctgaataatgcccgccgggtgatcatcagcgggcattatcgtcagaacttctgttttttctcctccaccttcaccccttgtgtcggtaggccggtgtcatagtcgcgtacaactggcgaatagccatcttgtggacgtggacgaaacgcccccatccagcgcggccgtgcatctttacgccacggacgcagactccattggtaactgcggaacggatcgcgaattttgtccatgtaatccaataaggcgtcatgcattttgctgcgaacgtctgcaaaacggatatcatcgatcaggttatgcatttcatttgggtcattacggcgatcgtaaagttcatcactggtgaagaggttgagtaccagtttaaagtcatccgtcacccagcaacgcaccggaataaaaccgccaaagctgtcatgctcaatctcgtagcggttaaattccaccatcacgccgcgtggctctttcacggcaaggatattttcccccggcagaatctctggtttttcaatatctgccagcgccatcattgtcggcagtaaatcgatatgactgactggcgtatcgacctgtcgccgctccccttgcggcgaacggatgatcagcggaatgcgggtgatgtcgtcatacatcgccgcccctttactgatcagcttatgtgcgcccatcatttcgccgtgatcggaggtataaataacccacgtattttcacgttgctctggcgttaaggcattgatgacccgtccgatttggtcatcaacaaagtcattacaggcaaaatagagcggatggtgataaagcccgtcatcaccgactggcgatggcatcgcctgcgcccataagcggtgatgttccggtttgttagccaggtcatcctgtgctttctcgcccagctcgtagtaaaaatcagcgtatttctctaaatactccaccggacaggtgaacgggtgatgcggctcatcatacgaaaccaccatcaggaaaggctcgtctgcgcgcgcaggctgttgcagaaaatccaccgcccgattgctgatacgatgcgcccaggtgaaggtttcgtcgatatggttcgcctgtaaatcttcgacgctgtttaggccattgcgccacaggctaatctctttttccgtcagttcgctaagatagttcgccccatcgaaccagtaatcagcgtcccactccggcggacactcgccagtgccgaaatagtcatgaccgtcgagatgccatttgccgatgtaacaggtgtgatagccggcatccttaaagtagcgccccatagtggagatgtttttgcctggcgcgacgttgttggtccacgggccggactggttagcgtagataccggtaaatagtccggcccgtgcaggcgtacaaaccggtgaacaggtgtaggcggaattaaagcgaataccttccgccgccagactatcaatattttgcgtattcagcggtttaccgctatagcaaccgaccatattggtggcctgggtatcggtcatgacgaacagaaaattggggcgtttcataggctatccttcccgtcgggagtaaaggttacggctgggtcgtgacgatgccgccagctgtcaaaaatcaggtagacaatcactacggcggcaatgaaataactgatcatcgctaaccagcgcgtaccgtagccgccgaattcagccagcccggcatagacgccaatcatcgcgaacaggatgccaattgacgcgatcttgacgtttttccacggtttcatgtccaccgcaaacgcatctttgaaggtgaacggcgtggcgcgcggtttgataaaaccgatcaccagcatcacgaccacgttgatgcagaacgtacaggccagcacatagaggaaatggaagtcgaacttcaccagatagttgatggtgatgtagctgattatgccaatccccatcgctacttttgccgccagcgccgggatgcgcgggaagaaaaagcccataatgatgatggtaaccagcggcacgttgtaaatgccgttgagctgtttcatccagctatacagcccctgcggcgcgttggcgatccacggcgcgaccagcaccgaaacgatagcgataaagaaaccaaatttgcgcccgacggtgaccagctgctgcggctcggcattctggttaatgatgcgacggtaaatacccatactgaataacgtactggcgctattcagaaagccgttgaaggtactgatcaccgcaccaaataacaccgcgccgaagaaacccaccattggcactggcagaacgttattgaccagcgtcgggtaggccatgtcggctttcggtaaatcctgatacagatgaaacgcaatcaaccctggcagcaccagtaccagcgggtcgagcattttcagcaccgccgttaacagcgcccccttttgcccttccgccaggctttttgacgccagcgtgcgttgcacgatgccctgatttgtacaccagtaaaaggtgttcaccagaatcaaaccggtaaatgccgcgccaatcggcaagggatcggtcgggccaccgattgagtttaatttctcggcgtgaacggtggtgagttgctcaatgccctgcataaagctgcccttgcccatcgcgattaggccaaataccggcaccatcaacccgccgataaccagcccaataccgttgatggagtccgccactgccattgcgcgcagtccgccgatcaccgcatacaaaattcccgccagaccaagcaaaattaccagtagccagatagccgcaccgtgagaaatctgtagcgattccccgacgtgaaacaggctgttgagcgccaacgcgccggagtagagaacaatcggcagaaagcagacgccggtggcaattaggaagcagaagtcgatgataatacgcgtcgttttatcataacgttcctccagaaaatcggggatggtggcaatgccgcgcttcagatagcgcggtaaaaagattagcgcgaggaagatcagcgtcaccgctgaagtcacttcccagcccatcaccgacatgccgcttttgtaggcctgcccggaaaggccgaccagttgttccgtggaaaggttggttagcattaacgaagcggcaataaccggcgcttttagtgaacgtccggcaagaaaatagccttgttgcgatccggtatctgttttgcggaccttccaccaggtgatcaccgccaccagcagcgtaaaaccgacaaaactcaagatttgtaacgaattcatctcatagcccttatttatgtttatgtcccggacgcatgaatatagggagaggtaaaatgcgtcgggtcaggcagtcagattcttaaaatacaaacgtcgtatccctgaacggattgttttctgttaagttcaggttgtgagcataattcgccggagggatattaaaatgaatggaaaattgcaaagttcagatgtaaaaaacgaaactccgtacaatattcccttattgattaacgaaaatgtgatctccagcggaatttctctgatctcgctctggcatacctacgccgacgagcattaccgggtgatctggccgcgggacaagaagaaaccgcttatcgccaactcatgggttgcggtgtataccgtacaaggatgtgggaaaattcttttaaagaatggcgaacaaataacactgcatggcaactgtattatattcttaaagccaatggatattcactcttatcactgtgaaggtttagtctgggaacagtactggatggaatttacccccaccagtatgatggatattcccgttggtcagcaaagcgttatttataatggcgaaatttataatcaggaactcaccgaagttgctgagttaataacttcaccagaagcaataaaaaataatctggcagtcgcttttctgacgaaaattatttatcagtggatttgtcttatgtacgcagatggtaaaaaagatccacaacggcggcaaattgaaaaattaattgccactttacatgccagtctgcaacaacgctggagcgtagctgatatggctgccacgatcccctgtagcgaagcctggttgcgtcgtctgtttttacgctataccggcaagacgccgaaagaatattacctcgatgcgcgtctggatctggcgctatcgctattaaagcaacaaggaaactcggttggcgaagtcgctgatacgctcaacttcttcgactcctttcatttcagcaaagcctttaaacataaatttggttatgcgccgtcagccgtgctaaagaatacggaccagcacccaacggatgccagtccacacaattaacgtaactctggccagtacgctttgttggcctccagcaactcatccagaatagctttggcgaccgaggcgctcggtaccgttttcgacaacgtaatcgcctgccacaggtgctgatatgaacgctgttcccaggcgtccacgaccagtttttccaccgccacttgctgactcattaaccctttctgaaactgcgggatatcgccgaccaccagtggttcaggccgtagtagcgcacgcgcatctgtttgcgatcttgcagcccaacaatttgcgccatccggctttcaataccgattggcatgtcacagatgttgaggattttcgcattcgggcgcagacgacgcgtggcttctgcgacaatggctgccgggttggagtagttgagcatccaggcatttggtgaatatttttccatataatccaccagttccaggacgccgccaatggaacgcatgccgtacgctattccgccgggtccgcaagtttcctgaccaacaacgccgtggcgcagcgggattttttcatccagttcgcgcatcgggtatttgccgacgcggatgtgcgccatgacaaaatcaacgtcgctgaatgccacttcaggatcggtggtgtaactaaacgcaatgtccggcgctttttctttaaggatgactttacaggcttcggcaatcacttcctgccgcgcaccatcgttatcataaaatttcagtgcacgaagcgggaaacggtcctgattcgccaggagcatcaacacgatgcctggcgtaaaggtgcttccaccgcctgcgacaaccactgagaatttggtcattatactgcctccgtaatggcaacattttctgctgattgatgagaattaattaagctatcgagctgttcacgcagctgagatacatgcagaccaatgatcacctgaatggcatcgccactacggaagacgccgtgcgctcccagctttttaaagacttcgtcatccagcgtttgtgacatgtcatgcagtgcaatacgtaaacgcgtcgcgcaattgttaatgctggagatattgccgaccccgcccagggcttgcaggataccggcagcctgatccagctctttttttggctctgccgcggtggtttggcctcgcgaggctttgtattcggcttttgagtagagtttcacttccgcatcttcacgtcccggcgtgcacatgttgaactgcagaatcagtgtgcggaaaaccacgaagtacagcagggtaaagcacaacccaatggcgatttgggtcagcatcatatccgcgtggttgctgaacatcgggatccagttttgcggtaaaacctagtcaatcagacctccgcccatgttgcccaccacaccaaagagatacattacggtcgacattgaggccgccagcacggcgtgtaccgcaaacagcaacggtgaaatgaacaggaaggtaaattccagcggttcggtaattcccaccagcatggcggttaaggttgcgggaatcagcaagcccgccacttttacccgattttccggtgcggcagtgaagtacatcgctaaagaaatgcccacggcaccaaagatttttgagttaccgtgcagggcaaaaccgccttccgggaacaacgatttcagcggctcggcgctcaaactgaactcttgcagatgctgcgcccagtacatctgaatgccgccttcaacagctgccggaccaaagataaactgtccgtagatgaagtggtgtaaaccggttgggatcagaatacgttcgaggaaggtgtaaacccagaccccaagtgcacccgccgaacgcaggaacgcttgcagagattcaatccccatttgtacttttggccagccgagcaacgtcagccaggcacaggggatcatcaccaggaaggcgataatcaccacataagacgtcccctggaaaatgccgagaaaaaccggcagttttttatcgaacagacggttatgcagcgccgtcacaatgccggaaatgataattgcgccgataatgctggtatcgagggttttaatcccggccatcattgtcagaccgctacctgccaccgcgtcctgagtgaaatcgacgccgaagtagcttccccaggtcattcccatcgcgttgatgaaatagttccaggtcaggaaactcaccatcaccgccagacaagcacgcccctgcgcttgcttagcaaggccaatgggtaaaccgacagcaaaaatcagcggcatattacggaataccgtccaaccgccctcttcaataatgtgtacgatttgcgcgaataaactgttcggatcggtcagtgattccccgacaaacatcgggttttgcagcaagatggcaagacccaccacaatcccggcgaagggaaacagcagcactggcgtgaacatcgcgccgccaaagcgttgaatttgactgagcatttccacatcctcttttctcaattctgtaagtaggaagcctgattggttatgcggcaggcctggagcgaggataggaagatgcgatcggcagaacatgacgacccaatgggattcgtgatcgctttcatgcttttcgttgggcggtagagatctacgttttcgcgaaaaagtagacctctgtgagcacaggtacacagcatcgaacacatctttaaaaaaaagatgttttttcaatcgattaagcagaacttgtgtgcgcattacccgggcttgcaggcaaaaaagagatctagagatgatctacaaaagcattgcggagcggttaagaattcgacttaactccgcagatttcacgctaaacagccttcttcccggtgaaaaaaagctggcggaagagtttgcggtatcgcggatgaccatccgtaaagccattgacctgctggtagcgtgggggctggtggtccgccgccacggtagtggcacttacctggtgcgcaaagatgtactgcatcaaaccgccagtctgaccgggctggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctgatgctggaagacagctatatgccggtaaaactgttccgtaatctttcgctgcaacatctggaagggtcgaagtttgaatatattgaacaagagtgcgggattttgattggcggtaattatgaaagcctgacgccagtgctcgccgatagactgctggcgcggcaaatgaaggtagcggaacacacgccactgctgcggatcacctcgttgtcatatagcgagagcggggagtttttgaattattcagtgatgttcagaaatgccagcgaataccaggtggagtaccatttacggcgactccacccggaaaagagttaaccgatactccagaagagcaccgccagtaattggggggtgataatgcgcaggaacattaccaacggatagacagtggcgtaagagagcgccgccgcaccgctggttggatgaagattattagcaaacgccagcgccggaggatcggtcatggaacctgccagcatcccgcacatggtcaggtaattcattttggctaacatccgcgccagaatgccaacagtaatcagcggaacggcggtgatcagggcaccataaccaatccagcttagcccttcgccattgaccagggtattcacaaaatccccaccagatttcagaccaacgaccgagaggaacagcacgatccccagctcccgcagcgcgaggttggcgcttggcggcataaaccagtacagcttgccgatactgccgatacgcccgaggatcaacgccataatcagcggtccgcccgccagccccagtttcaacgcggccgggaatcctggcacaaagacgggaatagaacctaacaatacgcctagcccgatgccaataaacactggcagcatctgaacctgttgcagtttttgctgcgcattccccagcacattggcaacggcatcaattgcggacggacgccccaccagattgaggatatcgccgaactgcaggctgatatcgccactggcgaccagttcgaccccggcacggttcaggcgcgagataacaacgtcatagcgttctttaaagtgcaggtcgcgaatacgttttccgagcacgttttcattggtgaccaccacacgctcgacgcgcaaatcagtgcctttcgtggacagcgaagtatcgacctcctgaccaatcaccagttgcgcattatgtaaatccgctggctgacccaccagatgcagcaaatcgcccagttggataatggtatctggcgaaggaacttttagggtttcttcgcgtttcagacgcgagcagataattttgtcgccgttgagaatcggtacatctttaatggctaaatcatgcaggttagggttctcaacgcgaatattgatagtcttgatcagcgcgccgccattggtgcgtgaagactcgtgctgctgagcttctgtctcgacattgacgcggaaaataacccgcaacatccacatggtgaacaaaatcccgcaaatgccgaatggatacgccatcgcgtaactcatccccatctgatcgaccatttccattggtgtacccaggtcgcgcaaaatctgctgccctgcccccagcgctggcgtattggtaaccgcaccggagaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggccctacctgaatcccgatagtataaacgaacaggatcaggccaaattcctgaataacatgcagcatatcgctacttaatgtcatccccgcctgagaaacaaaatggccgacgatgatcccaccaaacagcacgccgccaatacctaatcctatgccgcgaaatttgacgttgccgataaacaaaccgacgactgccaccaaagccagaatactgaccgttaatgctatatcactcatcgtccatttctcttgagataacattttaattgctacggattatggctgaatcggtgaagcagatttgccttatagcgcacattatcacgggaaagaacgtgccgaaatatcttaaacagtcgaaatttaacgcattgttgagtaagtaagacaaaaaaagccccaccagaatggcggggcaaagagaatagctagttagctatttaacgcgggacgttcgctgatagcgatacgctgcgctgcgatgggttcaggctcattacgaattaaatcaatatgcagtaaaccgtttacgaaggttgcgccagagacttccatattttcagccagcgtaaagctcaggctaaatggctgattcataagcccttgatgcagccattttttctcttcttttggctgctccggcgtgccttttacgctcaggcgcgtaccttccagttgaatctctaaatcttcctgacggaaacctgccagcgcaagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatggagatgtcaggccgcgccaggcggccttagggaattagttgatttcgatacggcgcggttttttcgcttccggaatcacgcgttcgagatcgatatacagcaaaccatttaccaggttagcaccacgaacatgaatgttctcagctaactggaatttgcgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcggtaatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatgtaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgatagccgccacagtgcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggagggaaagaaggaacgtatcccggcacccgcgccagcgcaaccatgattggcgacgatgaaaccaactggggcactaagtcgctggcgattctcgatatgccgtttaccgctgtgatggacacgcttttactgccgtgggatgtgttccgcaaagacagctcggtgcgctcgcgcgttgaaaaaagcgaagccaacgcgcaagccaccaatgcggttattccaccggccagaatgcctgataactgatttagcgatcagtttcggtgatccacagctggccgccttccatccacgccagccactgaccatccggcgagaagaccacggcgtccgcagaaggtgaattggcgtggtgttcggttaaatactcaacctcgccgctttgcgcatgggcacaagcaattcgattatccagcacaaagcccaaccattctcctgacggatgccagttaaatgcagactgaatatccgttttgttatgggttaactggcgcggctcgccgccctgtggcgagataagccacagttgcacaatgccgttatcatctcgcattaaaaacgcgatttgtgtaccctgcggattacagcgcacccagtggcgcgggacgttgactaaccccggataagcccgatggtgggtaaaggttaaacgtcgctgcacgacgccacgcggtggcgcgggcagggttgtttccgttccgcttaacggcgcatcacctgccgctttccagccagcttcatcttgcggtaactcaacgataaacagctccggcactttctcgccctttggcgaaagtgtgtcgccaataaatgccagcgcgtgatttcctacccatccttcttcataagcacgattgatttcatcactgccaggctgtggcgtgggcgtggttttgctcaccagcacgcaccagtggctaccgctgtattcacgcggatgctgcttttgtacgttgaccgggccaaacggcgcagcaacaccgacgtttcgcaaatccagcgccggatcgagttcatgcattacatggtcgttataggtaaagctcaccctttcaccgttcgggctaaagacatgcacatggctgccgccgcgcagcactcctggcgtatacggcgcggtaatatccatcgcatcaaggttactcatcttgccgccttcaacaatcactccgcgccgatgatggaagtcgtaatgccatgtttcatcaggattttccgggccgtggatgaaaacatatttctctgacttcggatgaacggtcaccacgccgacgtgtgcgccctgtgacgcgcgatagataacctcgacctcgccggtatggatattcacacgctcaatggtctcgccggtaaacgacgcgccagaaggacgcacgtcaaataccagccactggctgtcgggcgtccaggtattggtattggtgagcaggtgattacggggagcaaaggttatctgtttcatggcgcggtcctgatacaaaacgggtcccgccatcatacttcacaaggacttcactttcagacaatagtcttttgccatcgtgatgaatgtgagtgaaaagatggaacatttcgacgtggcgattattggcctcggcccggcaggatcggcgttggcacgaaagttagcaggcaaaatgcaggtgatcgcgctggataaaaagcaccagtgtggtactgaaggtttcagcaaaccctgcggcggtctgctggcaccggacgcgcagcgatcttttattcgcgatgggctgacgcttcctgtcgatgtgatcgctaatccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttatcacgacagcctgtgccgaaaaatctggcgtgaggatgataaatggcatgtcatttttcgtgcagacggctgggagcaacatattaccgcccgctatctggtcggtgccgatggcgcaaactcgatggtgcggcgacatctctacccggatcatcaaatccgtaaatatgtcgctatccagcagtggttcgcggagaaacatccggtgccgttctactcctgcatctttgataattcgataactaactgttattcatggagtatcagcaaagacggttattttatctttggcggtgcctatccaatgaaagacggtcagacgcgtttcacgacgctgaaagagaaaatgagcgcctttcagttccagtttggtaagacggtgaaaagcgaaaaatgcacggtgctgtttccctcgcgctggcaggattttgtctgcggtaaggacaacgcctttctgattggtgaagcggcgggatttatcagcgccagctcgctggaggggattagctatgcgctggatagcacagacattctgcgttcggtgttactgaagcagccagagaagctcaataccgcttactggcgcgccacccgcaaactgcgtttaaaactcttcggcaagatagtaaaaagccgatgcctgaccgcaccggctttaagaaagtggattatgcgcagtggtgtggcacatattccacagttgaaggattagccaacgcgcttcacatcgcccaccagcaggatataagagagcgcgccaatcaacgcgacggcggagatataaaccagtgcaggtgcgaaaccgtaaccctgcgccaggtaccccaccaccagcggaacggtgatgccgcccagaccaccggcgaagttaaacacgccgccggttaaaccaatcaggcgcatcggtgccagagaagaaaccagcgaccaggtaatcgaagcaaaaccgttaccgaagaatgccagcgccatcaggcacataatcatcatcggatcgttagtgtagttagcgcccataatgcaggtggagatcagcaagccgcagataatcggcgttttacgcgcaaagcccagtgaaaagcccttacgtaccagcagatccgctacccagccagagagcaggacgccgacaaacgccgcgaggaatggcaccgtggtcataaagcctgctttcagcgccgtgattcctttttcctgggttaaatagttcgggaaccaggttaagaaaaaccacagtgtagaagccaccgcaaattgcccaagataaacgccgatcagtttacgatggaacaccagtttccagtctttggctgttaacggctgacgcgcctctttcttcaccggcgcatcaccatccaccagaccgccgccatcacgaatgtaatccagttcagctttgctgatacctttggtcaggcgcggcggctgataaaccttaaaccaaatcagcgaccagataatgccgataccaccagtgacaatgaacacccagtgccagctcaacatctcctgaatccagatcagcagcggcgtcagaaacgccagaccgacaaactgaccagacgtataaaaaccaacggcagaagcgcgttcatgttccgggaaccagctggtcaccatccggttattggtcgggaaagcaggcgcttcgaaaataccggttatcgcgcgcagaccaattaatgacattaagcccgtggcaaagccctggaataaagtcgccactgaccagccaaatatcgcaataaaataagtcacgcgagaacctacgcgatctaaaaaccaaccgccggggatctgacatagcgtataaagccaggcgaaggccgaaaatacatagcccatttccgctttggtaatgccgaactcttcctgaatatgggcggaagccacggccaggttggcgcggtcgacataacaaatgactaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaatcactttagcttcgtcgatttccacgcctaagcccggtttcgttaacggtttaaagaagccgccgaccatgctgaagtcttctttgtttttcacaaagtcgagtaactccgcgcctttgttgtaatgaattcccatactttgttcctgaagtacggcgttataggaaacaaagtcgatatgcaggcaagccgccagtgcaatcggtccgagcggacagtgcggcgcaagggtcacgtcataggcttctgccattccggcgattttgtagcattcggtaataccgcccgcgtgggagagatccggttgcagaatcgaaataccacctgcctccagcacgcgtttaaaatcgaagcgtgagaacatgcgttcacccgccgccagtggaatatgcgtttgtgccgccagtttcgggtagtattcggcttgttccgccagcaccggctcctcaataaacagcgggcgatacggctccagttctttaatcagcactttcgccatcggcgcgctgacgcgaccgtggaaatcaagaccaaactcaatctgattgccaaaagcttcacgaatttgtgccacggtgttaaccgccgcatctaccgcgcgggagttatcaattagccccagttcttcacaaccgttcagtttgaaggtatcgaagccgatttcgcgtagcgttttaatgccgtcgataacatccgccggacgatcgccgccaacccaactgtaggctttaattttgtcgcgaaccaggccgcccatcagttgccagaccggcgcattcagcactttacctttgatatcccataacgcctggtcaatcccggcgatggcgctcatcaggatcggaccgccgcgatagaatccggcgcgatacatcacttgccataagtcattgatgcgcgatggatcctgaccaatcaaatagtcacccagctcgtgaactgccgcttccaccgtacgggcgcggccttcgatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcggtgcgctctacggattgcccggcgcgatagagatcgctgcctaagcccgcccctgcacaacctgcgtctatccactgcgccaggttttctggcgtcacgccgccaacggcaaagactgcgatgtccgatggcaataccgcttttaacgctttgatgtattgcggaccaaaagccgatgacggaaatattttcagcgcctgcgcgcccgcttcgagcgcggtaaaggcttcggtcgccgtcgcgcagccggggcagacggtcatgccgtagcccaccgcacggcggatcacttcactatggatattgggcgtaacgatgagctgacagcccatcctggcgagcgcatcgacctgttcaggtttcagtaccgtacctgcgccaatcaacgccttgtcgccgtacgcatcaacgatggcgggaatgctttgctcccattgtggggaattcagcgggatttcaaccgcgtcgaacccggcgtcaatcaccgcgccaacatgcgccagcgcctcgtcgggcgtaataccgcgcaaaatggcgatcagcgggagtttagtttgccactgcatgagcgatgctccttataccagcctgaaatgccgtgtcgcccgccaccgccgtcacgtcgcaacccatcgcctgaaaggcttgctggtagcgcgcggtcagcgatgttccggcgacaagggtgatggcgtgttgatgggccacatagtcgcgcatactggcgacctctgcgccaatcaacaaaccagagagaaattcgctgacctgttcgcggggaagtgttcccagcacatgcgaggcgcgaacttcaaaaagctgcggcaatatggcgggcgtattaagaccacgctcaaggccagctgtgaaggcatcggcagagttttcctgcggcggcaaacctgcgccaatcaatgagtgatttaacagtaaatgatgtaattcaccggtcatcacggtgcgaaaatcgttgatttgctggctatcggcctgcacccatttgcaatgggttccgggcatgacataaagagaggaaggagccagagctcgcgcgccgatcaattgtgtttcttcgccgcgcatcacattgtggttatcgtcatgagagacacataatccgggaataatccagatattgtcgccaactgacgttaattgttcgccaatagacgaaaaacaggcaggaacagataaatacggtgcaactttccagccgacgttgctgccaaccattcctgccattaccactggcgttttctcttcacgccagtcggtcgtgacttctgctaacaccgcagccggagattttccgttcaggcgcgtgacgcctgcttctgattgcctgctctccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgtcgtatcgcatcgaacagcgccttatgttcctggagcgtttgcggcatgttggcctcatcgcccatccaggttcgttcaaaaaccgcccgctgcagcgaactgatcgcaatgctaagttgctgtaacaccgggttatgcaccgactgcagcaccgcctcgtggtagcgaatatccgcttcgttaaacgcttcgcggtcctgattgttggcaatcatctcgttcagcgccgattcaatctgcgccagatcgctggaagtcgcgcgctctgctgcccaacgggcaatcgccggttccaccagatttcgcacttcgctcatggcactgataagccgtgggtcgtagtcattttccagcacccattgcagtacgtcagtgtcgaggtaattccactggttacgcggtgccacaaacgccccgcgataacgtttcatttcaatcagccgcttcgccatcagcgaacggaacacctcacggatgatgttgcgcgaggttgcaaactcctcacagagttccgcctcagccggaagcggcgagcctggcacgtatttgccgtgaacgatctgtttacccagcgtaatgacaatgcgatcggttttattgagagtcatggagagtccttgtgctctgtatgttcttctctactttaccccgatcgatgcataacgcggcaactttgtagtaccagcgtgatgacgttcgcgtttgccgtgcgtgtaatgtagtacaaacttatattgttgtactacaatttagatcacaaaaagaacaatgcataaaaaaatgacatgcgtcgggcagaaatctgaaaagggatatcaggcgctaaacaggagggaaagaagagtatgctttcaacggcttagctactcgtttaaaggattaatcatgaagttgaattttaagggattttttaaggctgccggtttattcccactggcgctgatgctttcaggctgtatctcgtatgctctggtttcccataccgcaaagggtagttcaggaaagtatcaatcgcagtcagacaccatcactgggctatcgcaggcaaaagatagtaatggaacaaaaggctatgtttttgtaggggaatcgctggattaccttatcactgatggtgccgatgacatcgttaagatgctcaatgatccagcacttaaccggcacaatattcaggttgccgatgacgcaagatttgttttaaatgcggggaaaaagaaatttaccggcacaatatcgctttactactactggaataacgaagaagaaaaggcactggcaacgcattatggttttgcctgtggtgttcaacactgtaccaggtcactggaaaacctaaaaggcacaatccatgagaaaaataaaaacatggattactcaaaggtgatggcgttctaccatccatttaaagtgcgattttatgaatactattcacccagaggcattccggatggtgtttccgcagcattactgccagtgactgttacgctggacatcattactgcaccgctgcaatttctggttgtatatgcagtaaaccaataatcagtaagcgggcaaacgcgtttatgctgtttgcccgcccacagattaattcagcacatacttctcaatagcaaacgccacgccatcttcaaggttagatttggtgacaaagttcgccacttctttcactgaaggaatagcgttatccatcgccacaccgacgcctgcatattcaatcattgcgatatcgttttcctgatcgccaatcgccatgatttcttccggtttaatacctaacacgtcggccagtgatttcacccccgtacctttgttaacgcgtttatcgaggatttcgaggaagtacggcgcacttttcagcacggtatatttctctttcacttcctgcggaatacgcgcgatagcctggtcgaggatggcgggttcatcaatcatcatcactttcaggaactgggtattggggtccattttctccgcttcgcagaacaccagcggaatggtggcaacgaaggattcatgcaccgtgtagtagctgatatcacggttggcggtgtacagcgtggtgcggtccagggcgtggaaatgagaaccgacttcgcgagagagtttttccaggaaacgatagtcgtcatagctgagagcagtttgcgccacggtgctaccatcagcggccttctgtaccagcgcgccgttataagtaatgcagtagtcgcccggctgttccatatgcagctctttcaggtagttgtgcacacctgcatacgggcgacccgtcgttagcacgacattcacgccacgggcgcgagctgcggcaatcgcatttttaacggcgggtgaaatggtgtgatcgggcagcagaagggtgccatccatatcgatagcaatgagtttaatagccatgagttccccaggtagattggttcctgacccatgctaacgcgattccgctcaaaaatcagtacaacacccgagggaaaagggggatgcaacgcgcgttgcgtgctccctttttgcttagcggaagagtttccctttcagcagttccatgcctgcggaaagcagatcgttattggcttgtggtgacacttcaccttgcggtgagagcgcatcaataatcttcggcaattgttctgccagtaaactggaagctgtactggtatccacgccaagtttttgcccgagatcggacaccgcatttgtgccgagcgccgattccagttgctcgccactaaccgattgattgccctgttgattactcagccaggttgagagaatggcccctaagccgccactttgcagtttttccagcagcacctgaatgccgccctgctcctcaacccaacttaaaatagcctgatatttccccgcatcgcctttcagaaaggcaccgacaacttcatcaaaaagccccatgataatcacctgtaaagcgttacgtgttgacccaaaaagtatagatttgcgggatgataattgcggattgcagaaataaaaagggcggagatgatctccgcccttttcttatagcttcttgccggatgcggcgtgaacgccttatccggcctacaaaatcatgaaaattcaatacattgcaagattttcgtaggcctgataagcgtagcgcatcaggcacgctcgcatggttagcgccattaaatatcgatattcgccgctttcagggcgttctcttcaataaacgcacggcgcggttcaacggcgtcgcccatcagcgtggtgaacaactggtcggcagcaatcgcatctttaacggtaacgcgcagcatacgacgactttccgggtccatagtggtttcccacagctgttccgggttcatctcgcccagacctttataacgctggatggagaggccgcgacgggactctttcaccagccagtccagcgcctgctcgaagctggctaccggctgacgacgctcgccacgttcgataaacgcatcttcttccagcaagccacgcagtttctcacccagcgtgcagatacgacgatattcgccaccggtgataaactcgtgatccagcggatagtcagtatccacaccgtgggtacgcacgcgaacaatcggctcgaacaggttttgctcagcattggtgtgaacatcaaacttccactggctgccgtgctgttctttgtcgttcagttcgctgaccagcgcgttcacccagcgggtaacggtctgctcatcagaaaggtcagcttccgtcaacgtcggctgatagataagctctttcagcattgctttcggataacgacgctccatacgattgatcattttctgcgtcgcgttgtactcagataccagtttctctaacgcttcgccagccaatgccggtgcactggcgttggtgtgcagcgttgcgccgtccagcgcgatagagatctggtactgatccatcgcttcgtcgtctttaatgtactgttcctgcttgcctttcttcactttgtacagcggcggctgagcgatgtagacgtgaccgcgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacagccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccaccaggtacagttcggaaagcgccggatcgcgttcctggcagtctgccagtttgcccggcaggcccgctaagtcgagcgcacctttacggcgggtcatttcacgcgcgcgacgcgccgcttcacgggcacgggcagcatcgataattttgccaaccacgattttcgcgtcggttgggttttccagcaggtattctgccagcagttcgttcatctgctgttcaaccgccgatttcacctcagaagaaaccagtttgtctttggtctgggaggagaatttcgggtccggcactttcacggaaacgaccgcaatcaggccttcacgcgcatcgtcaccggtggcgctgactttggcttttttgctgtagccttctttgtccatgtaggcgttcagggtacgggtcatcgccgcacggaagcctgccaggtgagtaccgccgtcacgctgcggaatgttgttggtaaagcagtagatgttttcctggaagccatcgttccactgcaacgccacttcgacgccaataccgtctttttcagtggagaagtagaagatattcgggtggatcggcgttttgttcttgttcagatattcaacgaacgccttgatgccgccttcatagtggaagtggtcttctttgccgtcgcgcttgtcgcgcagacgaatggaaacgccggagttgaggaacgacaactcacgcagacgtttcgccagaatttcatattcgaactcggtcacattggtgaaggtttcgaggctgggccagaaacgcaccatggtgccggttttttcagtctcgccggtaaccgccagcggggcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccgtcatcctgtacagagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcaacagcttaagctgcccacgcgataaggtatcttccaccggcgcaccgtcggcgcgaatgcgtaagtccgctttgtgcgggccgtgcgcggtgtaggttagctggcgatcgcgttcaaaattacgttccagcacctcagcatattctgtctctttctcccagccgcgctggaaagagaaagtcagagaaaactcagggagaaattgcttacaggtatcagccatatcggccgcgataccggcgctatactccgcgcgccaggtgctgatttgctccgccagcgggatcagctctttatcccacgggcgtagctgttcgtaacgtgtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcaactgcattggcatcaggtgcgccagttccgcgaccttatgcccgtctgtaccgtcgatgcggactttgctgtcgccctgtttgtctttggttaagccaatcgctgtctcgcgctcttcgccctgtaatcgcccgtggagaacaaacgcctcctgctcatggcgaatgacgcgaccaatctgcaaactgcgaaacgcccgaccatggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatcggtcagcatcatgcggacgttttcgcatttcagcgcgttcagaacatccagcacataactgacgttgaagccgatttccatctccgcaccgctataggtaacgtcgaggatctcttccgcttcttcctgttccgggttgttggcggtgattttcagctggttttcgctgacataaagacgtacgccgcggaatttctcgttagagagaatcgccgcgcgagcaaacgcctgcttgagcagatcgcagccagcttccagatgtttgtccgggttcttcggcagaacgcggcgataatccgggaagcgaccatccaccagtttggaggtgaagataaagtcgccaacgtgggcgcgaatgttgttgctgccaatctgtacgcgcagcggattgtcgccgccgtcgagcatacgcatcagttcaatcacgcctttacgcggtacgatcaccgaatggcttggcaaagattgaccaattggcattgaacagaccgccagacggtggccgtcggttgccacggtgcgcagttcttcaccttcggtttcaaacagcataccatttaagtaatagcgaacgtcctgatgcgccatagaaaactgggtcgcttcaatcagacgcttcatcgttgcctgcggcagggtaaattcgacttcactctgccagtcatcgaggttcgggaaatccgccgctggcagggtagacagcgaaaaacggctacgcccggagcgtaccagcatccgttcaccttccagctgcacggcaatttccgcgccttcaggcagaccacggcagatatcaaagaatttgcgcgccggaacggtcgtcgctcctggctcgtgtggctgaaccagcgcaacacgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaatttgaaaaatcttctttgatatcgtggctctcttcacgcaactgctcgatcttacggcaggcatgaagcaccgtcgtgtggtcacggccaccaaacgcatcgccaatctccggcagactgtggttagtcagctctttcgccagcgccatcgccatctggcgcggacgcgccaccgagcgggatcgacgcttggaaaggagatccgcgactttgatcttgtagtactccgccaccgtcttctgaatattgtcgatggtgaccagtttttcctgcaatgccagcaagtcgcgcagcgcctcacgcacgaagtcgatggtgatcgcccgtccggtaaagttggcattggcaatgacgcggttcagcgccccttccagctcacgtacgttagatcgtagacgcttggcgataaagaacgccacttcgcccggcaaacgaatgtcgttttcgtcggcctttttcatcaggatcgccacacgggtttccagctctggcggttcgatcgccacagtcagtccccaaccgaagcgggatttcaaacgatcctcaacgccgttgatctctttcggatagcgatccgaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccagacccgtgccgccataaaggaacaacgggttataggcaccgccagggttatccgccacctggcgagccgccgcgcgcgccagttggttagatttaccttcaacgaagttatcaaacgtgtgtttgacgtttacgttagaacgataggtcggttctgccggggccgggacgttatcccaacctgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcttgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggactttccagaactcgctaagtgtaaacgatcctgccgcgaggcgggcacgatttacgccgcatattggaaaatttaatgaccatagacaaaaattggcttaatcgatctaataaagatccaggacgatccttgcgctttacccatcagcccgtataatcctccacccggcgcgccatgctggtttccactggtgtgaggtcgtacattttccctgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgtggtggtgatgttgagcaagctctgctgcctgcttacccgaaagagctgaactctacccagccgttccagctgttggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctcctcgtttggtcagttgaagcaatccatcactctgccaccgcatctcgataccggaagcagcaacttcgcactgcacaccttccgtggcgcggcgtactccacgcctgacgagaagtatgagaaatacaagttcgataccattgccgataacgaaaacctgaacatctcttcgaaaggtggttgggtggcgatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaatccaggacaaaatggcagctgttgctccgcacctggatctgaccgttgattacggttggttgtggttcatctctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgttgcagccgaagattcaggcaatgcgtgagcgtctgggcgatgacaaacagcgtatcagccaggaaatgatggcgctgtacaaagctgagaaggttaacccgctgggcggctgcttcccgctgctgatccagatgccaatcttcctggcgttgtactacatgctgatgggttccgttgaactgcgtcaggcaccgtttgcactgtggatccacgacctgtcggcacaggacccgtactacatcctgccgatcctgatgggcgtaacgatgttcttcattcagaagatgtcgccgaccacagtgaccgacccgatgcagcagaagatcatgacctttatgccggtcatcttcaccgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcgcatccgccacacaaagcaacaggaacatcatgagcgataatgacactatcgtagcccaggccacgcctccgggacgtggcggcgttggcatcctgcgcatctccggcttcaaagcccgtgaagttgccgaaaccgtgctgggtaaactgcctaagccgcgctacgccgattatcttccgtttaaagacgccgacggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgctcgccctggtgagttttccgaacgcgcgtttcttaacgataaacttgacttagcccaggccgaggcgattgccgatcttatcgacgccagttcggaacaggcggcccgttcggcacttaactcgctgcaaggcgcattctccgcacgggttaatcatctggtagaagccctcacccacttgcgcatttacgtcgaagcggcaattgatttccccgatgaagagatcgatttcctctccgacggaaaaattgaagcccagctcaatgacgttattgccgatcttgatgcagtgcgtgctgaagcacgtcagggtagtttgttgcgcgaagggatgaaagtggtgattgccggacgtcctaacgccggtaaatcgagcctgttaaacgcgctggcggggcgtgaagcggcaatcgtaaccgatatcgccggaactacgcgtgacgtgctgcgtgagcatatccacattgacggaatgccgctgcatatcatcgataccgccgggctacgtgaagccagtgacgaagtagaacgtattggtatcgagcgcgcgtggcaggaaattgaacaggccgaccgcgtgctgtttatggtcgatggcaccacaacagacgccgtggatccggcagagatctggccggaatttattgcccgtctgccagcgaaactgccgatcaccgtggtgcgcaataaagccgatatcaccggcgaaacgctgggaatgagtgaagtgaacggtcacgcgttaattcgtctctcggcaaggactggtgaaggcgtggacgtgctgcgtaaccatctcaaacagagcatgggctttgacaccaacatggaaggcggcttcctggcgcgtcgtcgccacctacaggcgctggaacaggcagcggaacatctacaacagggcaaagcgcaactgttgggagcctgggcaggtgaactgctggcggaagagttgcgtctggcacagcagaacttaagcgaaatcaccggggaatttacttcagacgacctgctggggcggattttctccagcttctgtattggtaagtaaccgcgcttacgaagccgcattctgactgtcagatgcggcttcgcttcattgttaccactcctgttattcctcaaccctttttttaaacattaaaattcttacgtaatttataatctttaaaaaaagcatttaatattgctccccgaacgattgtgattcgattcacatttaaacaatttcagaatagacaaaaactctgagtgtaataatgtagcctcgtgtcttgcgaggataagtgcattatgaatatcttacatatatgtgtgacctcaaaatggttcaatattgacaacaaaattgtcgatcaccgcccttgatttgcccttctgtagccatcaccagagccaaaccgattagattcaatgtgatctatttgtttgctatatcttaattttgccttttgcaaaggtcatctctcgtttatttacttgttttagtaaatgatggtgcttgcatatatatctggcgaattaatcggtatagcagatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtttttatcgatttactgaccgacagcggcaccggggcggtgacgcagagcatgcaggctgcgatgatgcgcggcgacgaagcctacagcggcagtcgtagctactatgcgttagccgagtcagtgaaaaatatctttggttatcaatacaccattccgactcaccagggccgtggcgcagagcaaatctatattccggtactgattaaaaaacgcgagcaggaaaaaggcctggatcgcagcaaaatggtggcgttctctaactatttctttgataccacgcagggccatagccagatcaacggctgtaccgtgcgtaacgtctatatcaaagaagccttcgatacgggcgtgcgttacgactttaaaggcaactttgaccttgagggattagaacgcggtattgaagaagttggtccgaataacgtgccgtatatcgttgcaaccatcaccagtaactctgcaggtggtcagccggtttcactggcaaacttaaaagcgatgtacagcatcgcgaagaaatacgatattccggtggtaatggactccgcgcgctttgctgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtacaccgagtgcagaaccctttgcgtggtgcaggaaggcttcccgacatatggcggcctggaaggcggcgcgatggagcgtctggcggtaggtctgtatgacggcatgaatctcgactggctggcttatcgtatcgcgcaggtacagtatctggtcgatggtctggaagagattggcgttgtctgccagcaggcgggcggtcacgcggcattcgttgatgccggtaaactgttgccgcatatcccggcagaccagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaaggattaacctttacgtacgaaccgaaagtattgcgtcacttcaccgcaaaacttaaagaagtttaattaatactacagagtggctataaggatgttagccactctcttaccctacatcctcaataacaaaaatagccttcctctaaaggtggcatcatgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcccgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggttatcacgctaatccacgtattgtcgggatctgcacagccattttcgttgccagcgtattgtggttaagttcgttagccgccagtcgtattacctcattgttcctcgggctgaagattatctcctttgtgatcgtgtttggttcttttttcttccaggtcgattactccattctgcgcgacgccaccagctccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcaccatggggaatattccgcgagaaagctttaaggcgattatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaaatccttcaagaagccagccattcgctggcttcttgcctctcaggaaatcacttatgtccaaatggcaactcgcctgatcctccttcaccacgtatgctttgcgtcaccttactatcaggacgctttagcccatgtcccgctttttgatttgtagttttgccctggttttactttatcccgccgggattgatatgtacctcgttggtttaccgcgcatcgccgccgatctcaatgccagcgaagcgcagttgcatattgcgttctccgtatatctggcggggatggcagctgcgatgttatttgccggtaaagtggccgatcgttcagggagaaagccggtcgccatacccggcgcggcgctatttattattgcctcggtgttctgttcactggctgaaaccagcacgttatttcttgcaggccgatttctacaggggttgggcgcaggctgttgttacgtagtggcgttcgctattttgcgcgacacgctggatgatcgacgtcgggctaaagtgctgtcattactcaacggtattacctgcatcattccggtgttagcgccagtgctcggacatctgattatgcttaaattcccgtggcagagtctgttctgggcgatggcaatgatgggcatcgcggtactgatgttgtctttgtttattttaaaagaaacgcgcccagcggcccccgcagcttcggataaaccacgagaaaatagcgagtcgctgcttaaccgttttttcctcagccgtgttgttatcaccaccctcagcgtttcggtgatcctcactttcgtcaacacgtcaccggtattgctgatggaaatcatggggtttgagcgcggtgaatacgccaccattatggcgctgaccgctggcgtcagcatgaccgtttcattctccacgccatttgcgctgggaatttttaagccacgtacgttgatgatcacctcgcaggtgttattcctggcggcggggatcactcttgccgtttcaccttcccatgcggtttctctgtttggtatcacgctgatttgcgccggtttctcggtaggttttggtgtggcgatgagtcaggcgttagggccgttttcattacgcgcgggcgtagccagctcgaccttaggtattgcgcaggtttgcggttcgtcactgtggatttggctggcagcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctttgtctgcaactgctgatgcaggagcgcagcgtaaccaaagcggcgaagcggataaacgtgacaccttcggcggtgagtaagtcgctggcaaagttaagagcgtggtttgacgacccgctctttgtgaactcaccgctgggtctgtcgcccacaccgctgatggtcagcatggagcaaaatctggcggagtggatgcaaatgagcaacctgctgctggataaaccgcaccaccagacaccgcgcggcctgaagtttgagctggcggcggaatcaccgctgatgatgatcatgcttaatgcgctgtcgaaacagatctaccaacgttacccgcaggcgaccatcaaattacgtaactgggattacgattccttagatgccattactcgtggtgaagtggatatcggtttttccggtcgcgaaagccatcctcgctcgcgggagctgttaagctcgctaccgttagccattgattatgaagtgctgtttagtgatgtgccctgcgtctggttacgcaaagatcatccggcactgcatcaaacgtggaatctggacaccttcttacgttatccgcatatcagcatttgctgggaacagagcgatacctgggcgctggacaatgtgttacaggagctgggacgcgaacgcacgattgctatgagcctgccggaattcgagcagtcactgtttatggcagcgcaacccgacaatctgctactggcgaccgcgccgcgctactgtcagtactacaatcaactccatcaactgccgttggttgctcttcctctcccgtttgacgaaagccagcaaaaaaagctggaagttccttttaccctgctgtggcataaacggaacagccataatccgaagatcgtctggttacgggaaaccattaaaaacctttacgcgtcgatggcataaccgaatcgtatgaaacgcgacccaatttcacaataaaatgtaaaaaagttgtaataagcttgtctgaatcgaacttttagccgctttagtctgtccatcattccagtaaatgattactcttgtattcataatggaccattaagcatggagcgaaaaatggcgactcactttgcccgagggattttaacggaaggacatctgatttctgttcgtctcccctcccagtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggtaaaccggttttcagtgataaaaatttgccttcgttttccatttcctatgccgggaatatggttggcgtggcgttaacaaccgaaggtgaatgtggcctcgatatggaactacagcgtgcgacgcgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcagctgctgcccattgccggacgcctgaaatgtgctcatgtaaatcatgtagaagcgttatgcgacgcggaagacgtgctggtgtggtccgtggcggtcacgcccacgattgaaaagctcagtgtctgggagttagatggcaaacacggctggaaaagcctgccggatattcacagccgcgccaacaatcctaccagccggatgatgcgttttgcccaactctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaagtcaatgcgttaccatccattgccgacattcccttgtatgacgctgacgtacagcaggaagaaggttttccagcaacggttgaagctctggcggaacagatccgtcaggctgacggtgtggtgatcgtcacgccggaatataactactcggtaccgggtgggctgaaaaatgccatcgactggctttcccgcctgccggatcaaccgctggccggtaaaccggtattgattcagaccagctcaatgggcgtgattggcggcgcgcgctgtcagtatcacctgcgccagattctggttttcctcgatgcaatggtgatgaacaagccggaatttatgggcggcgtgattcagaacaaagttgatccgcaaaccggagaagtgattgatcagggtacgctggaccacctgaccgggcaattgaccgcatttggtgagtttattcagcgagttaagatctaaataaaaaacccgccagcaatcatgcatggcgggtttttaacgcgctatcgattttagtgagcgtcgataaagacaatcttcaggataaacagcagcgcaacgatgattacgcacgggcttagatcacgcagacgtccggtaccgattttcatcacgcagtaggagataaagcccagcgcgataccttcggtaatcgagaagctgaacggcatcatcacggcggtaataaacgccggaacagattcagtaagatcctgccagttcacgcgtgccagactggaagtcatcagcacgccaacgtaaatcagcgcaccagctgcagcgtagcctggcaccatccccgccagcggcgacagaaagataaccagcaggaacagcagaccaacaaccactgccgtcagaccggtacgaccgccaaccgatacgccggaagaggactcaatataagccgtaacggaagaagtaccgataaacgaaccggtcacggaagagatactgtcgacatacagcgcctgcttcatgcgcgggaatttccccttctcatccgccagacctgctttatcggtcacgccaatcagcgtaccggaggagtcaaacaagttgaccaacatgaaagagaaaatcacccctgccagcccgaggttaaacgacccggctaaatctacatgacccacaactgtcattacgctcggcggcgcagaaacgatgccattgtagtgcacatcacccagcatccagcccagcagcgtcgtcaccacgatagaaaccagcaccgctgcgtgaatgttgcgcgaggccagaatagcaatgatgaagaagccgaggatacccagaagtacgctgtgagaagtcagattaccgatgctcaccagcgtttccgggttagcgacaatcacacctgcgtttttcagccccatcatgccaatgaacagaccgataccgctggtaatacccacacgcagactcaccggaatgttggctatcatccagtagcgaacgcggaaaatcgtcagtaacagcagacctatcgcgccccagaagattgcgcccatcccgacctgccacggcaagcccatcgcctgtacaacgacaaaagcgaagaacgcattcaggcccatagcgggtgccagtgcaactggcaggttagcaaacagtcccatcataatactgccgaatgcagcgatcagacaggtagtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctgaccagaagtctgggtggtatgttgatgactcattatctatttccgaacaaggagggaaaatccgtcgctatcgtataccaaaatgcgacaataggcgcgtttgtgagagacttttttattggatttacttatacggcaacgattgcgttgcgcaaatcggctctacgaaaacgttaaactgattaaaaaggaaaggcatgtcccggatagaagcggtatttttcgactgcgacggtacgctggtcgacagtgaagtcatttgctctcgcgcatatgtaacgatgtttcaggaatttggtattacgctcgatcctgaagaggtattcaaacgtttcaaaggtgtaaaactgtacgaaattatcgatattgtttcccttgaacatggtgttacgttagcgaaaacagaagctgaacacgtttaccgtgcagaagtcgctcggctgttcgattcagaactggaagccatcgaaggggctggagcgctcctgtcagcgatcactgcgccaatgtgtgtggtatctaacggcccaaataacaaaatgcagcattctatgggcaagctgaatatgttgcactacttcccggataaactgttcagcggctacgatattcagcgctggaagccagacccggcgttaatgttccatgcggcaaaagcgatgaatgtaaatgtagaaaactgcattctggttgatgactcagttgccggtgcacaatctggtatcgacgcaggtatggaagtgttctacttctgcgccgacccgcacaataagccgatcgttcacccgaaagtcaccacctttacccatctttcgcagttacctgaactgtggaaagcgcgtggttgggatattacggcatagttcttcacactcccttcacttaccccgcttaaattggcgctcaaaggtaagtaaagggagtttgatatgtctgtttcacgtcgggtaatacatcacggactttattttgcagttttaggaccgttaattggtgttctgtttcttgtcctctacatattcttcgcaaaagaaccgctggttctttgggtgataatacatccaatttttctcttattgtcgataactacgggagctattcctgcgttgttaaccggtgtaatggttgcctgtctgccggaaaagatcgggtcacagaaacgttatcgttgtctggctggtggcataggtggcgtcgttatcaccgagatctattgtgcagttattgtacatattaagggcatggcttcctcggagttgtttgaaaacattctttctggtgacagtctcgttgtccgcatcattcctgcattgctggcaggtgtggtgatgagcagaatcattacccgtctacccggattggatatttcatgtcctgaaacagactctttaagttaagcgggatactttatctttgggctactcaaaagcagacaggatgtttctatgactcaaaatatcaggccgttaccccaattcaaatatcatcccaagccactggaaacaggcgcatttgaacaggataaaaccgtagagtgcgattgctgtgaacaacagacgtcagtttattactcgggtcccttttattgcgttgatgaagttgaacatctctgtccgtggtgtattgcggacggttctgctgctgaaaagtttgcaggtagttttcaggatgatgccagcatagaaggtgttgaatttgagtatgatgaagaggacgaatttgccggtattaagaacacatatcctgatgaaatgctgaaagagttggttgaacgcacgccaggttatcatggatggcagcaggaattctggctcgcgcattgtggcgatttctgtgtttttatcggctatgtgggctggaatgatataaaagatcgcctcgatgaatttgccaaccttgaagaagattgtgagaatttcggtattagaaattctgatctagctaaatgcctgcaaaagggtggtcattgtcagggttatctcttccgctgtctccactgcggcaagctgagactgtggggtgatttttcgtagttatttaaataatgagaacaggccggagcgtaattcacacatccggccttatttcttaagcttaaccgagtgctaattctgcggcagcggctttatcagcgattaccatcagcgaaggatgcagctgcaacacggaagctggaacatcttcggtaaccggaccttgcagaacatttttcagtgcctgcgctttacccgcgccgctgacaattatcagcaagtttttcgccgccatgatgcttttcggccccatcgtcacgtagctgtcaggcactaacgaaaagtcgccgcccaactcgccatgcgccacaatatcaaccatctctccctggatcgggaactccacggtttgctcatggaaatgggtcgtattcggcaaattgccacaaaaatgaccatctgcacctaatcccagcaccaccaaatccagtccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcaaaattatagaaatagcagttatcgtaccagggcttacctttaaccagggtggtgaggtattcatacatgcctttgggcgtgctaccggcggtaattgccaggttaacacgacgcgtcttcgacatataaccaagcagatggtgtgccgcgacacggctcatttcctggtaatcttcggtaatgattaatttcatcttaatgccttattttatttaaataatttctgtacaaaggctgcataggctggtcgccagacatccatttcatggttcagacccggatattcctggtaatcaaagttaatttttttctgctcaagctcagttttcagcccggcgatatccttgccggttacgacatctttatcccccacaaccacagtaaaattacgtagttgctggttgatagctgccggatcgttcagtcgggccgcgacaccttcatccggtacggttgtcgtggtaacaccactgaatgtggccagccagccaaagctttccagatgattcattccggaaaccagcgcctggtacccgccttgtgaaagccctgccagcgcgcggccatcggcatctttacggacattaaaacgcttgctaatcagcgggataatatcgttcatcagttcgcgatctgccgctttagcattcagcggataaaagactttacgtctttcctgaggcacgaaatcttcgggaataatgcccttcgcatcggtttctgtatccgggatcaccaccagcatcggtttaattttcccttcagcaagcaggttatccatgatttgcgggatacgcccctgatcgatagcggaacgtccggtatcaccaaagccgtgatagaaatagagcactggcaaaggctcgcccatgccggtgtatcctggcggggtccagacatacatctgacgttcagattgcaatgcgttggagtggtaagttatggcgatcaaatcaccatgcgcaacagaacgcgtatccagataactgcctggcaccagaatcatactggagttaacctggcgctgaggattagtcattgcggtgcctgtatcaatgctgcgtacaccatcaacattgaaaaaatactcgtacaggttgcctttcaggataggtgtgcgccacgaccagactcctgcttcgtctttggtcatcgggtgaatattgtccggaaccggaacacccaccactacagagacattttttgccccaggggcaaagtagcgaaaggtcacgctgttatcggcattgacctgagtcacatactgtttcaccgggatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccggacgcgaggtcaacatactggtattgactttaaaggtatggaagagcgtggttttataaccagactcattaaatttattactattcgcatctttgttttgctgggtgaaatagcccagttcaacacctgtctggttatattggtcccaaatataggccgggcgaacaaccgcacgaatagattcgaaatcagagtgggcgcctgtttcgtagctatatatatcgttaccgaaggagtaaacaatcgcgttagctacaatgaaatgatcgccaatataggcttcgccctgcgaagtcagacgtaccgctgttccgccggtgtgatcaccataataacgaccattaaaggtggtaaatggacttgcgccagcataacggccaaagttactggcgatagagttattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccacttaccattaaggtggctttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacccgctgcggcatcagtacgctgcgttttccagtcaagcatctggatttcaattttcggcgcaccgtgtttacccacccagaaatcagcctctggcgcaaagggcaggaaacctttggtggtaacgtacatatcggagaactgcatatagttctcgccaccggcgttatcgccaaaccagccggtagagtactgctgaccaacgttaccatccatcatcacaacggcatcaacccgtttgccgttttcgttgtagacacgttgttttaactgcaaatcaaaccagccggagtattcgttaccaaagcggcccagagaaccaatcgcccatgatttaggtgaaccatgagaggcggtcccccaaccagaacggtaatagccgttgtaactaaagccaatttcatctttcacaaatttactgaaatctttcagagtcatggaagaataaatcgagcctgtctcactggcatttttctcttcatttttgaccagtacagcatcaggttttgcggcactactggtcgggaacggattggcggcatacccttgatcattcgtacttacgctacgattcaccgtcgctggcgtatactttttcttctcttcatctttatactttttgagttcgctttgcgtttctcttaacgccttttctaataactcaaggcgttgttccaccgttaatgattcagccaatgattgtgcagaaaaggctaacggtgccattaataagatggcagaggtaataagatttcgtctaaacataatatccctttatggtgcaaagaaagaattaacgcatcgcatccagactgttctgaatgcgacgataattaaggtgctttaatggttattttttttaatgacagcccccgcgtcttgatcacctctgcataccatccgaagcttttcttgcgtgttcttgtgaggcttccttcgccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccgcttcaacgctgtcttttgcgcctaatccgttctcgacaataaataacggtttttgataacgatcccaaagcgtatttaacagaacccgtaatccaaccggatcaatttgccacccccactctgaacttttcagatgcggattggggatcatattcagtatgttgccctgcgcatttttattaatgctttcgtcgtgggaaacacaaccagtcatgtaataactaaaagagatgaaatcgacggtatgttttaaatcttctgcgtcactttcagtcatctcaatggtgatattgtggtcgcggaagaaacgctgcatatagccgggatactggccacgcgcctgaacatcaccaaagaacatccagcgccggttctcttccatggcctgcaacatatcctgtggctggcaggtgagggggtaaaccagcccaccgagaagcatattgccgattttcgcttcggggagcaggctatgacaggctttaactgcccgcgcactggcaaccagttgatggtggatagcctgataaacttccgcctcgccactctcttctgccagccccacgcccgtgaatggcgcgtgtaacgacatgttgatttcattaaacgtcagccataacgccactttatgttggtagcgagtaaagaccgtgcgggcgtaatgctcgaagtgatcgatgaccgctcgattagcccaaccgccgtagtttttcaccagcccatatggcatttcgtaatgggataacgttaccagcggcttgatccccgcctgcgccatttcatcaaacagccgatcgtaaaacgctaaccccgcttcattcggttcgacttcgtcgccctgagggaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgagatccctttgccatcttcctgccaggcaccttccacctgattggcagctgttgcgccaccccaaagaaatgtttctggaaatgctttcataattaactccttttatcgttagcgaatgatggataacagcggttcacctgcgcttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacaccatcatctgactcaatgccaatggcgtgtaatgtggcgaacaacgaagcaattcgacccgcaaccggagaacgcacttcaccaaccgagggcagaatggcaatacctttacccaacaggccactggcaaacgtggtatcagcgacgtgaatgagcggcacaatctctcccgtcatcggtgaacagataccgccctgctcaggtggtgtaataacctctggtgttttctcttgcggggcaccctgcgctggctgacgtttagcggtgatgaaatgaagcatcaccgtaccgacaaatgcgcaaccgatggcaatgacaccgccaataacgctggcccagacggtgaaatcaattcccgttgacgggatggtttgcatgaaggtgaaaatacttggcaaaccaaaggagtagactttcgtttgcgcgtagccaataatggtggcccccaaagccccactgatacaggcgataacaaaggggtacttacgcggcaggttgacgccatataccgctggttcggtgataccaaacagactcgtcaacgccgctgatcccgccaccacttttttctgcgcatcgcgttcgcagaggaagacgccgagcgccgccccgacctgcgccataatggcgggcattaacagcgggatcatggtgtcgtagcccagcacggtgaagttattgatacacagcggcaccaggccccagtgcagtccgaacatgacgaagatttgccagaagccgcccattaccgcgcccgcaaatgcaggaaccgcctgataaagccagagataaccggcggcaatcagttcgcttatccaggttgatagcggccccaccagcagaaaggtgacgggtgtgataaccatcagacatagcaatggtgtgaagaaatttttgattgccgacggtaaccacgcattaagtcggcgttccagaatgctgcacaaccaggcagaaaaaataatgggaataaccgatgacgagtaattcaacaatgtgaccggaatacccaggaaatccagccccagcgcatccgctttttgcccgttctcgaaagcagtcagaattaatggatgcactaacgctccaccaatcaccatggcagtaaatggattaccgccgaagcgtttccccgcggtgtatcccaggattatcgggaagaaccaaaacaaggcatcactggcgctgaataaaattaaataagtaccactttgttcggtcgtccactgaaaagtgagcgccagagccagcatacctttcaagatcccggttgccgccatcaaaccgatcagaggcgtaaaaatacctgaaataacataaacaaagcggtttagcagattacctttatcatcattttccggtgcctgttgcgctttttcgtcaaggcctgccacactgttaaccgccaggaagacatcggccacatggttacctatgaccacctgaaactggccaccgctttccaccaccataataataccgggggtctttttcagtacctctgcttgcgctttgctttcatcctttaatttaaaacgtaatcgcgttgcgcaatgcatcagactcacaatgttatctgcgcccccgactcctgcgactatttttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttactcagtaataatatttcagtgttctttgcgcacgcgctctatatttatggctaaaaacataatctctgcgggtgaaattttacgttgatactgcaaaccaataaaaatggcgatccgttccgcacattgccatgcttgcgggtaattttgttttactgcttgttgtaatgattcatcactatcgttaattgaagcatgttcaagaatacgccaggataaaaacttcagatgtgtaaccagtcgctgataactcaagctttcttcctggtaattaaggctgaactgaaattttattaattgcagcatttcgcgcattaactgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagccgctggatatcccacagcaacgggttgggcagcaacacgttttgctgaaagcgtttaatcgcaaactggcaatggtcagttagcgagatataaatactgtcctgtaattttcccaagcgctcctgcgctaaagagataatacgatcacaggttgccatcacctcaagaggaatatgacttaagagttcgcttaatcgcccgttcagttcatgactgctcaaggcatactctttttctattccacttgagttaattctttcgccagcgcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcatttattaatggtttttataacgaacatccaggttcggaaattaatttaattgcgtgcagagaaaatagcaatgcgctattgataaaaatatgaccatgctcgcagttattaactttgtgtaattttaggaatttataaagttatatataacaaatcccaataattaagttattgggatttgtctggtgaattatttgtcgctatctttccccgccagcagtttatccagctcatcgccaccgacgtgacggaaatcctgccccttcacgtagtagaagataaactcacaaatattctggcagcggtcgccaatacgttcgatagaacgcgcgcagaacagcgcagtaagtacgctcggaatggtacgcgaatcttccatcatgtaggtcatcagttgacgaacaataccttcgtattcctgatcgacttttttatcttcacgataaatacgtaccgcttcgtcaatgtccatccgcgcgaacgcgtccagcacgtcgtgcagcatctggatggtatgacggcccagcgactccagacttaccagcaacggctgatgctgctgggagaatttctccagcgcagtacggcagattttgtccgccacgtcgccaatacgctccagctcggcaatggttttactgatcaccataaccagtcgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatactttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtagagatagggtcgagcgccgaacacggttcgtcgagcagcagcacttccgggcgaatggcgataccacgcgcaatacacagacgctgttgctgaccaccagagagagagtaaccgctctggtgcaatttatctttggtttcgttccacaatgcggctttggtcaatgcccactgcacgcgctcgtccatgtcggcacgggagagcttctcaaacagacgaacgccaaaagcgatgttgtcgtagatggacatcggaaacggcgtcggtttctggaacaccatgcccactttcgcacgcagcagtgcgatatcctgagagttggtcaggatgttgtcgccatcaagcagaatttcaccttccgcacgctgctccgggtacagttcaaacattttgttgaaggtacgcagcagcgtcgatttaccgcagccggacggcccgataaacgccgttacctggtttttagcgatatccaggttgatgtttttcagggcatggaatttgccgtagtagaagttcaaattacgaacctgaattttactcggggcagtttcaaccatactcattgcaatcttttcctcatcgtgcctgatgcacttcgctaatcaggcttaccgtaggccggatcaggcgttcacgccgcatccggcaaagtgttaaccgtgtacagagtcaaaaaggcgctcggtcggtcccctcgcccctctggggagagggttagggtgaggggaaaaccgtgtcagcaatatcaaccgtgtttattcttcgcaaaaacaacgcgcgccagaatgttcagcagcagtacgcacagggtaatgatcaataccccggcccaggccaattgctgccattccgcaaacgggctcatcgcaaacttaaagatcgtcaccggcaggttggcgatcggctgcatcatgtccgtgctccagaactggttggagagcgcggtaaacagcagcggcgcggtttcaccagcaatacgggcaatcgccagcaggataccggtcataatcccggacaccgacgctttcagcgtaatcgcagagatcatcttccacttcggtgtacccagcgcataagccgcttcacgcaggctgtacggcaccagtttcagcatgttctcggtggtgcggataacaatcggcacctgcaacaacgccagggcaatcacgcccgcccagccggagaagtgctccatctgcgccaccacaatggtgtaaacaaacagaccaaccacaatcgacggcgcagagagcagaatgtcgttaatgaagcgaatcacttctgccagccaggatttacgaccatattccgccagataaatccccgccataatgcccagcggcgtaccgaataccgtggcccacaaaattaacagcccgctacccgccagagcgttcgccagaccaccaccttccgtattgggcggcggcgtcatttcagtgaacagcgccagcgacataccgtcgataccgcgagtgatggtggacattaaaatccagatcagccagaacaggccgaaggccatcgtcgccatcgagagcgtcagcgcaatacggtttttgaggcggcgacgcgcctgcattttgcggcgagattcagccagcgccgcagtggtttgcatttcaaccatagccattagcgtgccccctcattcttagccaggcgcataatcataaacttcgatgcggcgaggacgatgaaggtaatcacaaacaggatcaggcccagttccatcagtgcggcaacgtgcagaccggattccgcttccgcaaattcgttcgccagcgcagaggtgatactgttgcccggcatatacagcgaggcgctgtcgagctggtaggtgttaccgatgataaaggtcaccgccatggtttcaccgagcgcgcggcccagccccagcatgatgccgccgataacaccatttttggtgaacggaagaacgatacgccagataacttcccaggtggtgcagccaataccgtaggccgactctttcatcatcaccggggtttgttcgaacacatcacgcattaccgccgcaatgtacggaataatcatgatggcgaggatcacgcctgccgcgaggataccgataccaaatgcggggccagagaacagcgcgccaacaatcgggatattcgacatgatattgccgaccggctcctgaaagtaaacggcgaacagcggcgcaaagataaacaggccccacatgccgtaaacgatacttggaatggctgccagcagctcaatggcgatacccagcgggcgtttcagccagccaggcgcaagctcagtcaggaacagggcgataccgaaactcaccgggacggcgatcagcagcgcgataaacgaagtcaccaacgtaccgtagatcggcaccagcgccccgtagatatcgttcggtgcatcccactctttggtccataggaaagccagaccaaatttctgaatgctcggccaggaggagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttaccgctactgtctttaatattggtcttccacgcagcgcgaacctgttcaactacactatccggcaggctggcgtaatccaggtcgttcgcctgtttagccccggttttgtacgcccagtcgaagaatttcagcacttctgtgccttgttctggtttcttctgatctttgtggatcagaatgaacgtggtagaggtaataggccatgcatcttcgcctttctggttggtcagatcctgagcgaaggttttgctccagtctgcaccttttgctgcattagcgaagttttcttcggtcggactaaccggtttaccatcagcggagatcagtttggtgtacgccaggttgttctgcttcgcgtaagcatattcaacataaccaattgcacccggcagacgctgaacgaacgcggcgataccgtcgttacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttttgtgaaggcagtttcagacccggattcagtttggcgatggcttcatcatcccacttcttgattttgcccaggtagatgtcgccgagggttttaccatccagcaccagttcgccagacttcagccctggaatgttaaccgccagcaccacgccgccaatcacggtcgggaactggaacagaccttcctgagccagtttttcgtcagacagcggcgcgtcagaggcaccaaaatcaacggtattagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcactcatcgataaggtcgcggcgacaacagttgcgacggtggtacgcataactttcataatgtctcctgggaggattcataaagcattgtttgttggctacgagaagcaaaataggacaaacaggtgacagttatatgtaaggaatatgacagttttatgacagagagataaagtcttcagtctgatttaaataagcgttgatattcagtcaattacaaacattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgtaaccgattttgccaggttacgcggctggtcaacgtcggtgcctttgatcagcgcgacatggtaagccagcagctgcagcggaacggtgtagaagatcggtgcaatcacctcttccacatgcggcatctcgatgatgtgcatgttatcgctacttacaaaacccgcatcctgatcggcgaagacatacaactgaccgccacgcgcgcgaacttcttcaatgttggatttcagtttttccagcaattcgttgttcggtgcaacaacaataaccggcatatcggcatcaattagcgccagcggaccgtgtttcagttcgccagcagcgtaggcttcagcgtgaatgtaagagatctctttcaacttcaatgcgccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagcttcgccaccagcatcaacagcacagttaactgagtggtgaatgctttagtggatgccacgccgatttctgtacccgcgttggtcattagcgccagatcggattcgcgcaccagagaagaacccggaacgttacagattgccagtgaaccaaggtaacccagctctttcgacagacgcaggccagccagggtatccgcggtttcgccagactgtgacaaggtgatcatcaggctgttacgacgcacggcagatttgcgatagcggaattcagaggcgatttcgacgtcgcacggaatacctgctagcgattcaaaccagtagcgggaaaccataccggagttataagaagtaccacaggcgaggatctgaatatgctcaaccttcgacagcagttcgtcggcgttcggtcccagctcgcttaaatcaacctgaccgtggctgatgcgtccggtaagggtgtttttgatcgcgttcggctgttcgtagatctctttctgcatgtagtgacggtaaatgcctttatcgcccgcgtcatattgcagattggattcgatatcctgacgttttacttccgcgccagttttatcgaagatgtttaccgaacggcgagtgatttccgcaatatcgccctcttcaaggaagataaagcgacgggtcaccggcaacagcgccagctggtcagaagcgataaagttttcgcccatccccaggccaatcaccagcggactaccagaacgtgccgccagcagggtatccgggtgacgggagtccatgatcactgtaccgtacgcaccacgcagctgcgggatagcacgcagaacggcctcacgcagagtcccgccttgtttcagctcccagttcaccagatgggcaatcacttcggtgtcggtttcagaaacgaaggtatagccacgcgcttttagctcttcacgcagcggttcatggttttcgatgatgccgttatgcaccaccacaatgtgttcagaaacatgcggatgcgcattcacttctgaaggttcaccgtgggtcgcccagcgagtgtgagcaataccagtgccgccatgcagaggatgttcttccgctgcctgtgccagcatctggactttaccgaggcgacgcaggcgggtcatatgaccttctgcatcaacaacggccagaccggcagagtcatatccgcggtattccagacgacgtaaaccttcaagaaggatttctgctacatcacgttgcgcgatcgcgccaacaattccacacatagtttttgattccgatttatatcgttgtcggtcaacctgtatgcccgttttttcgggcgccccgagccttgtagagagtggggttatttttatagttactgcttgtgggagggagattatgttatctcctcatcccatgtgaccgggttagccggccagaatcactttttctttaccggacgacgccagccttctttctgagtctgcggcacacggctgatagctaatgcattttcgccgacattacgcgtcacagttgtacccgcagcaatggtcgcgcctttgcctactgttaccggggccaccagctgagtgtcggaaccaacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgagcaccttccagcaactcagcaccaggacgcaaacgggcaaacgggccaatggtacaggccgctgccagattcgcatcttccacaacggtatacggactgatttcgcaatcatcgccaatcacgctgtttttaatcacgcaaccggtgccaattttcacgcgatgaccgagagtcacgttgccctcgatgataacgttagtatcaatttcaacatcgcgcccgtgagttagcgtaccacgcagatcaaaacgcgctggatcgcgcagcataacgcctgctaacagcagtttttcagcctgttcggactgataaacacgctccagacgggagagttgcaggcggttattcacgccttctacttcgcttaaacgttgcggatgaacggcgacgatttcacgcccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagtttcaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcattgcatgacccgtacccagctgctctgcctgaagcacccagttaaggttgtcgtctttcagcgcctgttttagcagatcgccgccgtgaccgtacaccaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttaatttaagcgtcaggtggatgtttttgctcttatttcgatcaatgaataaacaggaaaacaggggggttttatatcagcaggatctatgtgaacgctattcaggacgggtcacacgcgcaaaaaaaagccagcctgtttccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgatgatgtctttcagttcctgataacgttgcaggatggactgaacgccacgcgcggtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccagttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaatgagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcaatcgggtgttcgaggtcttttacatccagaccgcgacgcagaccgtcggaggaacccattgcgatggtacgtacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccaattttcgacagttcaacatccgccaggtaaccacgttctgctgcgaacagaaccagagactgctgcgcaacggacatcggcgcatactgtttctgtttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagtgcggtcagagaaccggttttccctttcacttcacctttggtgaaggcttcaacgtattcggcgttaacacgtgcagcacgctccagcagacgagagtggaggtagaaaacgtcgcccgggaatgcttcacgtcctggcggacgacggagcagcagggagatctgacggtaagcaacagcctgtttagacaggtcatcgtaaatgatcagcgcatcttcaccgcggtcacggaagtattcgcccattgcgcaaccggcatacggtgccaggtattgcagtgcagcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttacctgtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggacccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccataacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttcgcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtccgcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacaccgctggtcgcctttttggctacgctacggaataaaaccaggaacaacagacccagcaccaccgagaagaacatggagtcaatattgattgtccagaaggtggctggggggttttgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgctaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacacaacaaaaaccacccattgacatttttaataatgttttaacagccaatgatggttcttagcgccgatttttagcagactgatattttcactaatgacttattttctgcttaccaaaaaaagccacgttatcttgttgatgcaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcttcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgaaggaaactcttctaccctgctctgtactggttcaatattctccagtttaagctcatgttgcacctgacgaaggaaacgcacgcgtttaccaaggctatccaacagagtgaaatgggcttcaggacgcacgatagagagtggaatgcctggcagtcctggtccggtgccgacatcgataaaccgttcaccttgcagatacggtgccaccacaatgctatcgagaatatggcgtaccagcatctcattaggatcgcggaccgaagtcaggttgtacgctttgttccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatggccgcaggcgtgacgccagaaatacgcgaagcttggccgatagaggctggtttgtgatcgttaagtttggcgatcacttcgttagaaagaccggatacctggcggtaatccagtgtcgcgggtagcagggtgttctcgttacgcagctgcttttcgatctcatcttgctggcgcgcgatataaccttcgtatttaacctgaatctcaacctgttccgccgcctgttcgtctgtcaacgcaggggcaaacggcgtcagcgtggttaatttttcataagtcatttccggacgacgcagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcacgaccgatttcagtcaaacgcagatccgcattatcttcgcgtagcatcagacgatattctgcgcgcgaagtaaacatacgatacggttctttggttcctaaagtgcacaggtcatcaactagtacgccgagatacgcctgagaacgtgccggagcccaaccttctttgtcagcagacagacgggcagcgttaagaccggccagcaaaccttgcgcagcggcttcttcgtaaccggtagtgccgttaatctgaccagcaaagaacagcccctggataaacttgctctccagcgtcggtttcaggtcgcgaggatcgaagaagtcatactcaatggcataacccggacgcacgatcttcgcgttttccatcccctgcatagagcggacgatttgcatctgcacatcgaacggcaggctggtggagataccgttcggataaatttcattagaggtcagtccttccggttcaaggaagatctgatgctgatttctgtcggcgaagcgcatgactttgtcttcgatcgacgggcagtagcgtgggccgacaccttcgatcacccctgcgtacattgggctacgatcgaggttactgcggatcacatcatgggttttctcgttggtatgagtgatataacacggcacctgctggggatgctgggacgcattgcccataaacgagaataccggcattgggttatcgccatgctgttgcgccagtacgctaaagtcgatggttcgagcatcaatacgcggtggtgtcccggttttcagacgaccaacgcgcagcggcagttcacgcaaacggcgagaaagcggaatggacggcggatcaccagcacggccaccgctgtaattatccagaccgatatgaattttaccgtcgaggaacgtcccaacggtgagcacgacggctttggcacggaacttcagtcccatttgggtaacagcaccgaccacgcgatcgttttcgacaataagatcttcaaccgcctgctggaagatcatcaggttcggttggttctccagcgccgtacgtaccgcctgacggtagagcacacgatccgcctgagctcgggtagcgcgaaccgccggtcctttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataacgcggtatgaaaatggattgaagcccgggccgtggattctactcaactttgtcggcttgagaaagacctgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctggaccgtataagctgggatcagaatgaggggttatacacaactcaaaaactgaacaacagttgttctttggataactaccggttgatccaagcttcctgacagagttatccacagtagatcgcacgatctgtatacttatttgagtaaattaacccacgatcccagccattcttctgccggatcttccggaatgtcgtgatcaagaatgttgatcttcagtgtttcgcctgtctgttttgcaccggaatttttgagttctgcctcgagtttatcgatagccccacaaaaggtgtcatattcacgactgccaataccgattgcgccaaagcggactgcagaaagatcgggcttctgttcctgcaatgcttcatagaaaggagaaaggttgtccggaatatctccggcaccgtgggtggagctgataaccagccagatccctgaggcaggtaaatcttctaacagcggaccgtgcagcgtttcggtggtaaaacccgcctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttgatggtacgcatgatcgggttttgcaggacgatcaatgtctcggtggactgaatttcatcaattgtttggatcttgttgataagtacatgctggagagcgtcgatcgaacggcacatcacttttataaagatgctgtagtggccggttgtgtaataggcttcagtgacttcatcaaggctttccagctttgccagcgcggaagggtagtctttggcgctctttaatataatgccgataaagcagcctacgtcataaccgagctgcttcgggctgacatcaatacgcgccccggtaatgatccccgcctgcttcattttctctactcgaacgtgaatcgtccccggactgacgccaaattgtttcgccagttcggcgtaagcggtgcgcgcattgcccattaatgcttccaggatgccacggtccagattgtcgatcagataattttccataggattttcttatgcggattgatgattcattctattttagccttcttttttaatgaatcaaaagtgagttaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcgccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttctccgttgcactcggtctatgttgaccagtgggactgggaacgcgtaatgggcgacggtgagcgtcaattctcgactctgaaaagcacggtagaggcgatctgggcgggaattaaagcaaccgaagctgcggttagcgaagagtttggcctggcaccgttcctgccggatcagatccacttcgtacacagccaggagttactgtctcgttatccggatcttgatgccaaagggcgtgagcgggcgatagcgaaagatcttggcgcggtattccttgtcgggattggcggcaagctgagcgatggtcatcgccacgacgtgcgcgcaccggattatgatgactggagcaccccgtcagagctgggccatgcgggtctgaacggcgatattctggtgtggaacccggtactggaagatgcgtttgagctttcctccatggggatccgtgtagatgccgacacgctgaagcatcaactggcgctgaccggtgacgaagatcgcctggagctggagtggcatcaggcgctgctgcgcggtgaaatgccgcagaccatcggcggcggtatcggccagtctcgtttgactatgctgctgctgcaactgccgcatatcggccaggttcagtgtggagtatggccagctgctgttcgcgagagcgtcccttctctgctgtaataatttatcgccgccagcgtctgagcaggcggcttcgcatcccggtatcaaagcgccagatatgatcgaaaatgcgcatgatgccgggtttgccgtgtgccgacatcgccacggcatgaaagcgatgctgatgtacccgctgcagctctttcactttactcgtcacgtcgtcaggcaaccgctgagcgataaaatcagaaatcaccaccgcatcggcatcaaaccattccctgctttgcaagcgttccataatggcgcgaaaacaactggcaagatcggtgccgccacgaaactgctggcttaaaaaacggattgcttgttcgatgccttgtgggcctgaaagctcataacggacgatctcggtggaaaatagcataatatagcagcgccggttttctgcgagagcaatgcgcatcaaggccaggcagaacgctttcgcacactgttcattaaagccgcccattgagccggaagtatccacacagacaataaacggcccgcgcggctgttcatcgtaatctttatgtaccaccggacgttcgatcactttttcacgccacgactcaccgtgcaggcgataggtgagcaactgtttttccaccagccgacggtaaaactcatactccagttccgttatccctagtgtcgccagttctggcggcaggagacgtaaaatatcatcgctttgttgcagaccatcaacctgctcaggaaccgtcgccggttcgcgcaccatggtgcggaaggtttccatctgcgcatcgttgcgcggtattgatttggcttcccgagaacgccccagctgctctgccaggcgtttcagttccggctgttcgttaagaaattcaccgtatttcacaatcaactgatagtcgccacgtttaagctgaccggcgctcatatcccacagacgaccagctgcagtattgttatctgcgagaatcggttcaagttgtccgctcagcgtcatgcgttcctgaacttcactcaacagttgttcgcgttcttcttctaatagctgttgatttaacgtcgttgcttgcacgatcagacttaaacgccaacgctggagaaaaagcgtgtgtaacgctgaagtgatcgtgctgttagcatcaaccaactgtcgggcttgttctgcccatggagaattcagacgatgcagtaagtccaggatctgtggtagctgcacaataaactgtggcgtggagaggagctggctttgctgatagcacatcacctcttcggtgagttccggcgggactcgggcatctttcagccgactgcgcagcgcttcacgccagcggggaacatcatcagtgattgccgccttcaggcgtgggaatttttcaaagaagaccgccagctgcggtgaggccagcagtgcgatgatcatctcttcgatcaatccctcttcgctgacggccagcatcacattaagcgtatccagcgttagcattgttgtgcctggcgaatctgtgcaccgacatcctgtaggctggcttcaatgcgacctaaccagtcgccagggataaacagacatttttgctgttcgctgaataaagcgtgttgcttgcgccagtcgctttcaagctcttccagttgttgttttatttcaccaggcagaccttcagccgatgaaccgggaagtgccagcgtactgccttgtaaacttacatcgcgaacgacaagatgttgggcgctatcaacttccagattcagtttctgggcaaagccgataccgttcagtttaccgcgaatttcaccacctttgctcagccactgttccagcgcgctacgctcaaaggagatatgaaccacttccatatcatgcagttttaacggtttttgcagcagtagagtcagagtggaagcagtaacgttaacaggaagttgatactgctgacgacggctgaaaatgccgcccagacgaattaccgttaaggctgttttatcgctttgttgctgctggagttgcaggtgacgttgcacaatcgcgccaaggcgagtcaacatcccttgctgttgccaggcgtgaccggtcatcaatacatcaatttgttgttgtatcaaattcaggctttgcgcgtcataccacaggcaatctttcagcaaaatgagatctaccggggcaacagcactgcgaccgctaaaaaaggcgctggcctgcaataatcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgacctgcaaggcatcaggaaccggattgtcgttttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgtgtgcaccgttgcggaactggcgctcgttaatggcggtgagcaaggtattaagaattgccgggcccgctttccagatctcatccagaaagacaatttctgcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggcgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaagggggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcgttgaacgcgatgccgtgtttggctttttatcgctgatcttctggctgctaatctttgtggtttccattaaatatctcaccttcgtgatgcgggcagataacgccggtgagggggggatcctgacgttgatgtcgcttgccgggcgtaatacgtcggcgcgaaccacatcaatgctggtgattatggggctaatcggcggcagctttttctatggtgaagtcgtcataacacccgctatttcggtgatgtcagccattgaaggtctggaaatcgtcgccccgcagctggatacctggatagttcccctctcaattatcgttctcactttattatttatgattcaaaaacatggcacggctatggtcggtaagctgtttgcgccgatcatgctgacctggtttttgattctggcaggactggggttacgtagcattattgctaacccggaagtgctgcatgcgctgaatccaatgtgggcggtgcatttcttccttgaatacaaaacggtttcttttattgcattaggggcagtggtgttgtcgattacgggggtcgaggcgctgtatgctgatatggggcactttggtaagttccctattcgcctggcgtggttcaccgtcgtattaccttccttgacccttaattacttcggtcagggagcgctgttgttaaagaacccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacctccgaaatggagtcagggcaaatctatattccgtttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattccattgttcaccgctaacctcgataaactgctctccggcggctggttgccattgagcctcggtactgtgatgtttatcgtgatgaccacctggaagagcgagcgtttccgcttgctgcggcggatgcatgaacatggtaactctctggaagcgatgattgcttcgctggagaaatcaccgcctgttcgcgtgcccgggaccgcggtgtatatgtcgcgtgcaatcaacgtcattccctttgcgctgatgcataaccttaaacataacaaggtattgcatgagcgggtgattctgttaactctgcgcaccgaagacgctccatatgtccataacgtccgtcgggtacagattgaacaactgtcgcccactttctggcgcgtggtggcaagttatggttggcgagaaacgccaaacgtagaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgtgcaccagatcaatttgaaatcccgccaaacagggttatcgaactgggtactcaggtcgaaatctaacgccagacgcctcctttcttcataagggggcgtttttgttttcatggttaatcaccatgtaaaacgtttcgaggttgatcacatttccgtaacgtcacgatggttttcccaactcagtcaggattaaactgtgggtcagcgaaacgtttcgctgatggagaaaaaaatgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggcggccattatcgcggaagagatcaaacaccataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccaaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttatcggtaggttctctgttggcgctgaccggcgcagttgctgcatctatcgtcggcattgaagtcaatgcgctggtggctgtcgctgctgctctcgcgttaggtgccgcaattggtgcggtaaccggggtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgttcgcggcacaaaaattctgctgattaacccgaccgactccgacgcagtgggtaatgctgtgaagatggctaaccaggcgaacatcccggttatcactcttgaccgccaggcaacgaaaggtgaagtggtgagccacattgcttctgataacgtactgggcggcaaaatcgctggtgattacatcgcgaagaaagcgggtgaaggtgccaaagttatcgagctgcaaggcattgctggtacatccgcagcccgtgaacgtggcgaaggcttccagcaggccgttgctgctcacaagtttaatgttcttgccagccagccagcagattttgatcgcattaaaggtttgaacgtaatgcagaacctgttgaccgctcatccggatgttcaggctgtattcgcgcagaatgatgaaatggcgctgggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggctgtggctgctgggcgtagcggtgcgaatatcgcgtttattgcctgtacgggtgatgacagcattggtgagagcgttcgccagcagctcgccactgataacattgatattactccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggtgcgttaatcacggcattgctggaagaaaaaccattgccagaggcgattcgttttgcccatgctgccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattaccgccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtctcgtcctttgcaataccgaaggcgatgaacagcggatgaatcgcaatctggaaacgctgatgcaaaaacgcgttgatggcttgctgttactgtgcaccgaaacgcatcaaccttcgcgtgaaatcatgcaacgttatccgacagtgcctactgtgatgatggactgggctccgttcgatggcgacagcgatcttattcaggataactcgttgctgggcggagacttagcaacgcaatatctgatcgataaaggtcatacccgtatcgcctgtattaccggcccgctggataaaactccggcgcgcctgcggttggaaggttatcgggcggcgatgaaacgtgcgggtctcaacattcctgatggctatgaagtcactggtgattttgaatttaacggcgggtttgacgctatgcgccaactgctatcacatccgctgcgtcctcaggccgtctttaccggaaatgacgctatggctgttggcgtttaccaggcgttatatcaggcagagttacaggttccgcaggatatcgcggtgattggctatgacgatatcgaactggcaagctttatgacgccaccattaaccactatccaccaaccgaaagatgaactgggggagctggcgattgatgtactcatccatcggataacccagccgacccttcagcaacaacgattacaacttactccgattctgatggaacgcggttcggcttagatttacgctgtcttttgatcaaattattaccatcggttgttttcagaagcatgaacattgctgctgaagcaacagtaataatgcccattgtgataaacgtatagtggaattgttcgacagtcgttgtgccttccattccttcataaacgcgaaggacggccgcacttacagcaacgcctaaactaatcgacagttgctgcgtgaccgccagaacactgttaccgctgctggcattgtcatcggtcagatcggcaagtgtgatggtattcatcgcggtaaactgcgtcgacatagccatccctaatataaacaacggcaagatcagcatccatatagccattgctggtgattgcaaagagaactgagcgatcattagcccaataatcaccgtgatccccactaacgtatggcgatagcccagacgacgtaagacttgggtaaccatcgattttgcaataatggaacctaacgctgtcggtgccatcatacagccagcaataaacgcctgataaccaaatcctacctgtaacatcaatggcataaggaacggtacacagccggtccccagacgggttgcaatattgcctacgataccgatcgagaaagtgcgggttttaaataaatctaatgaaattaatgggtttggcgtgcgtcgtgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtgatatcgaatctgcgtcgtgcggtggtgaaattgggcatatgtttgcgcgcgtaaagaaggcccgcaatacctatggggatattgattaaaaatatccagtgccaggttgcccaggtgaccagcacgccgccaagaacggggcctaaaattggccccaccagacccggcatggcgacaaaattcaatactggaagaagttcattacgaggataagcgcgcagtaaggccagccgagcaacaggcatcatcattgcgccgcctatcccctgaataacccggaagacaaccagctgtggtagcgaattagaaagtgcgcaggccagagaacccaatgtgaacagactcacggcaagggtaaaaatgcgacgcgtaccgaagcgatcggctagccatccgcttaccggaataagcatcgccaccgtcagcgtataactgatgatggctgattgcatcgcgagaggagaacgattaaggctatgagcgattgcgggtaaggcggtattaagaatagtggcatcaagtgcctgcatgaagaaggccatcgccgcgatccacggcaaacccgccatactgcgcttctttttatcgctcattcaatgtcctgttatcgggttatcacttatcaggtgagcgtagcagcgcctgacaagctttaaatgccgcgtcgccatcgctttggataatcgcatcgacaatcgcctgatgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgctttctgttccgcggtgccaaccgttgctgccagtaggcaggcttgcggctccagacagatacgcataaccagaaagtgatcgatgacctgatgaaagttctcttctgtcatccaccaggtaagcaattcctgatcaagaaaattccagttcgattgtggcatgacccgagtaccaattcgcggtcgcggtaaaaccatcccttttgccgttaacgttttgaccgcttcgcgtaccgctgtacgactcactccaaattgctcgcccagctcaatctcaccgggcaaaatggtgccgggttcatattcaccttttaagatccgttgcgccagcttctcagccagaacatacgaaaggtttttctgtgcagctaactgttgtgcgcttaaaggcattacttatcttcctttttctttttattcctccttagtatgccaccaggaagtgtgattacggttgcaaaaacggcaaattgcttgttttatggcacattaacggggcttttgctgaaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaagcgtattatgcacaccccgcgccgctgagaaaaagcaaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgataggaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtatgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggagctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattaaatcagaacgcagaagcggtctgatgaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaaatccttctaccggcatccttgccagccattcatattaatacacttcatccagcacgttaattttcaaaagatcgcgaatcaacgcatttttatcgctattttgcagccatatggcataaagcggccgtgaaagtgttgtgctatcgacaacggtatgcaggccgccttttttacgcgcccagctgacgggtagccaggtgcaaccattaagcatcgcaatctgttgctgtgccagttcagcagaactggttgtcagaatgggcacttcgtcagcaccgatcaaacctgcctcatgctgttgaaaatctggcccccactcaagtcgcagataattaagatctccctttagttttgaaggggcactggtataaagcgctaaagtgaaatatcccagcaactgactactaaattcgtccattttgggcgcttcagtggtaataagaagatcaagctggcgttcatgcagctgttttaccagagactgccgttgggcaattcgcgcttcgaactgtaagcctgtatgggcatcctgattttgatacaagcgtcccagccactgattaagcatacattcccacaacgaggcgctggcaccgatagaaaactcgttatgtcgtgaggtatgcgccacctccttacgggcggcctgccaggtgctcatgagcgtttctgcataaggcagtagtttttcaccggcagcggttaaacggatattgtttctgtggcgggtgaaaaggttcacacccagttgattttccagttgtctgattcgaaagctcactgctgactgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgatttcaccatcaaagaggcacaactgcttgagcgtcatggttatgccttcaatgagttggatcttggcaaacgcgagccggttaccgaggaagagaaactcttcgtagcagtatgccgtggcgaacgtgagccagtgacagaagcagaacgcgtgtggtccaagtatatgacgcgtattaagcgtccaaaacgttttcacaccctttccggcggtaaaccgcaggttgaaggtgctgaagactacaccgattctgacgattaataaaaagggcgaaatgccctttttttatgtcagtagtttctgcagatggatgagcaaacggtcaatcgctcgatagctaactgcctcctgcaaatgctgacgtgtgataatgtcagactgatcaatatcagcaatggttcgtgcaactttcaataaccgctgccaggcacgaatcgataaccccagatggatcagtgttccttccaaccacatcgcatcttcgctctcaagtttgcagaattggcgtatttccggactatccagccaggcattcagtttattctgccgcttaaattggcgctctctggcggccattacgcgttgtttaacggtggcgctgctttctcccggcactaccgttttactcaaaatgccggggggtggtaatgggatctccagtgagagatcgaagcggtcgagaaagggccccgagagccggttgagataacgtaatgtctgttctggcgtgcagcggttatggtttccctgataatgtccggtagggctgggattcatcgccgcaacaagctggaaacgggctggataggttatttttgctcgtgtgcgtgaaagatggatctgcccggattcaatcggctctcgcaaggcatccagtgtacgccgttcaaattcaggtagctcatcaagaaaaagcacgccgttatgcgccagcgaaatttcaccgggccctggaattgcgccaccgcctaccatcgcagttaacgatgcactgtgatgaggtgagcggaacgggcgctgccgccattgtttttgtactgattcagcatttaccagacttaatatcgcagcactctccagtgcctcttcattgcttaaatctggcaacaggccattaatacggctggcgagcattgttttacctgttcccggcggcccaatcagtaaaaggttgtgcccgccagcagcggtaatttccagtcctcgctttccttgttcctgaccgataacatcactgagatcatgttgtagcgcccgggatactgcatcagttggtttcgggcgttcgagagcgtgcttaccttccagaaacgcacagacagcttgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagcaacgcaatggcgataggtaaatcatatcgtcccccttcttttggcagatcagctggagccaggttgatggtgatttttttcgccggatattcatatccgctattgataatggcgctgcgcacgcgatcgcgagcttcttttaccgttgtttctggtaagcccaccatcgttaagccgggtagacctttactgatatgtacctcaacagtgatcgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatgcagcggacaaaggatgaactacgaggaagggaacaacattcatactgaaattgaatttttttcactcactattttatttttaaaaaacaacaatttatattgaaattattaaacgcatcataaaaatcggccaaaaaatatcttgtactatttacaaaacctatggtaactctttaggcattccttcgaacaagatgcaagaaaagacaaaatgacagcccttctacgagtgattagcctggtcgtgattagcgtggtggtgattattatcccaccgtgcggggctgcacttggacgaggaaaggcttagagatcaagccttaacgaactaagacccccgcaccgaaaggtccgggggttttttttgaccttaaaaacataaccgaggagcagacaatgaataacagcacaaaattctgtttctcaagattcaggacggggaactaactatgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcacagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctggggatgcacggcaccaaagcggcaaacttcgcggtgcaggagtgtgacctgctgatcgccgtgggcgcacgttttgatgaccgggtgaccggcaaactgaacaccttcgcgccacacgccagtgttatccatatggatatcgacccggcagaaatgaacaagctgcgtcaggcacatgtggcattacaaggtgatttaaatgctctgttaccagcattacagcagccgttaaatcaatgactggcagcaacactgcgcgcagctgcgtgatgaacattcctggcgttacgaccatcccggtgacgctatctacgcgccgttgttgttaaaacaactgtcggatcgtaaacctgcggattgcgtcgtgaccacagatgtggggcagcaccagatgtgggctgcgcagcacatcgcccacactcgcccggaaaatttcatcacctccagcggtttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccatggccaacacatcacccggaaagaccaggttgaagcggcactcgacaccatgctgaacagtgatgggccatacctgcttcatgtctcaatcgacgaacttgagaacgtctggccgctggtgccgcctggcgccagtaattcagaaatgttggagaaattatcatgatgcaacatcaggtcaatgtatcggctcgcttcaatccagaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataaatacaaaaaatgggacggcacgcaccgtcccatttacgagacagacactgggagtaaataaagtatgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaataatggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgcaccgggcagggcagcgcgggggcaatcagcactactgccagattctccagcatcgaaaacgccactgcgccgggcaaggtttccggtttacccgcaatcgccagatccgcttcaccagtgaccaccttttccatcgcatctgccgcatcaccagtagtaagtttaatctccaccgacgggtgttccgcgcggaagcgatccagaatcggcggcagatggctgtaggcagcggtcaccgagcagaagatatgtaattcgccagagagcgacggcccttgctgatcgatggtgtggcgcaactgctgatactgcaacagcgtttgctgggcgaaaacgcgcagctcttcgcccgcttcagtcagcgtcaccgtgcggttatcgcgcacaaacagcggctgaccgagatcttcttccaggcgctgaatctgccgtgagagcgtggatgggctaacgtgcatcgcccgcgcgctgcggccaaaatggcggctttccgccagatgcaggaaggttttcagatcgcgtaaatccacagggacagccctcgatgttgacgttgcaaaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaagtgcgcgctgatgccctcaccccgaccctctcccacagggagagggagaaaacactcaaggccttctcctggagaaggccttgctattagttgcggtacagcaccttaatgatgtgatatccgaactgggtgtgcagcgggccggtcggctccagtaccggacaagagaaaaccactttatcgaacgccggaaccatctgaccctggcggaattcacctaaatcaccgccgcgtttgcctgatgggcaaatggagtgtttcttcgccagcttgccgaaatcggccccgttcttaatctgctcgagaagatccagagccagtttctcttcttttacaaggatatgcagtgctgctgctgtttttgccatgatcgtgccttgagtgaataattgtcaggcggcgattttagcatgatccgcagatgctaacgtaattgtcagtcagggagtggctggtacatatatggcaaaagcccggaaaatccgggcctcgcaggtccctcaaggggagaaaacttagggcctctatgggctacaaagtcattatcggggatggttattttattgtcaatttatgagcgatatggcattgattgacttgatgaccgccctctgtatgtctgcaaccaactcatgtggcaaacattgattaagataccctctgtaagtccttgctctgtttaatctgtttcgactgacttgttgtaccaggtcggctttggcccaacgaatctgctgatcaaagaattgcaggtcattgataacattactggctatttcaacatgcattccacgttttaacttgtctggtcgcgagtggttgataatggaacgacgatgcatgcgttgccattaatttttccgttgagcacgacaactaacctgttttttatcatttcaggaggaatgcggccatcgtaatacgtcgtgctgaacggtccattttggctaacaggatagttaccaaagttgcattccagtatttcaccaaccttagggctgaaattaatcgccacgagtaaacctctccttagtaaactctgaaaaagtaataacacaacgttacgacccgatattttctaagtctaatggattcacgatgaactccgatttcggtcttctctctctgatttaaacatccgcagccaaccggttagcggcttacacgcggtcacattcaaatgcgattctgctacaatcctccccccgttcgaagattgagcaatacacctatgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaacgcaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataatcaaggccggaaaagatgcgtcagcatcgcatccggcacttactcattaatgcacttccagcggccagtggacatagctctgccactggctttcctgagcaataatctctttacccagcggatgttgggttagccaaccttgcggaagcgtcaaggtcaacagttcatggttagcctgtaatgtcatctctggcacgagatcgtcacggcgacggctggcaaaaatgatggccaggcgtagtaaacggcagagttgttctgcgacgcgcggcggtacggcattttgctgatgcagcgatgagagatcgaccggattagtctggttgagcagtagcgtcgccagcaattttttctgtgcgggggtaaaaccgggaagatccagattacgcaccagataagcagcgtgttgcggcgcttgtttgaagtcaacgctcaggccgatttcatgaagctgacaggcgctgatgagcaaatcgcggcttattgcttcaagatgccattcgttttccacctgatcgaagaagttagccgcaactttggctacgcgctgtgcctgatcaatatcgatcataaagcggcgttgaatattacgcagcgtacggctgcgaatatcctgctcgacggccagatgcaacatgccgtagaccaggccttcacgcagcgcaccgcccgccagggtcatacactgaatattcagttcggtaaaaatggcgatcaggatcgccagaccactcgggaacactaacgcacgttccagcgtcagcccgtcaatctccagttcctccagccgaccgcaatgaatggctcgctgtttcaattgctgcaacttttccagggtaatgcgttcatccatcccctgtgccatcatgatttcctgtaacgcctgcacggtgccggaagcaccaacgcacactttccagccgtgataccgtaattcatcggcaaccggacgtaacacttcgcgtgccgctttttctgcagcatcaaaattttcctgccccagattacgatcggcaaaatagcgttccagccaggtgacgcagcccatcgacaggctgaacaacgaggtggtttgtgcacccgtgccggttaccagttcagtactggctccgcctatatccaccaccaggcgctgatcggcaccaccagtggtgtgagcaacgccctgataaatcagacgtgcttcctcttcaccgctgatcacctgtaccggacaaccgagaatttcctgcgctttggcaataaaatcacccgcattgacggcaaggcgtaacgtcgccgtagcgacaacgcgaatttgcgagggaggaatatcttgcagacgttcagcaaacaggcgcaaacattgccaaccgcgctccattgcttcattggagagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgtgttggctgcattctttcacctgaatcacttactacagtaagctcatcgggattcattctcttgccatcttgatacagtttgaatgattttgagtatgacattttttatttaacctgaacgacgacgattacgcggagcgccagtacgacgcggaccattgcctgtgcgcgggcgcgtgaggcgcagcggttttggcagatcggtcatcaatgcgtccggattgtatttgcttaccggaattgagtgaccaatataggtctcaatagcaggcaaattcaatgcatactcttcacacgccaggctgatagagtgaccgcttgcgcctgcgcgacctgtacgaccaatacggtgaacgtaatcttcacagtcatcgggtaaatcgtagttaaagacgtgcgtcactgccggaatatgcaaaccacgcgcggcaacgtcggtggcaaccagaatatccagatcgccacgggtaaattcatcaagaatacgcagacgttttttctgcgcgacatcgcctgtcaataaaccgacacgatgaccatctgctgccaggtggccccagatctcttcacaacggtgtttggtgttggcgaaaataatcgctctgtctggccactcttcttcgatcagcgtttgcagcaaacgcattttttcttcgttagaagggtagaaaagctcttctttaatacggtggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgccccgtggtgccaatcagaatgtcaacgccgctttccagcactttcagctgtttgtcgtagccatcaccaccgtaagccagacccagcttcaggccagtagcttccgccagcggttctgcgtcggcatggatctgcacggcaagttcacgcgtcggtgccataattaaggcacgcggctgattcaccttgcgatcggcaatcgcaggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctactgaagatttaactgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggccaaacgcctggttgagcacaagaaagacgttatcattctgctcgactccatcactcgtctggcgcgcgcttacaacaccgttgttccggcgtcaggtaaagtgttgaccggtggtgtggatgccaacgccctgcatcgtccgaaacgcttctttggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttctggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggaatttgctggcatgttatgcaatttgcatatcaaatggttaatttttgcacaggactggtgggtttggaacggactttcccttctgaataaaggtcttcgtggttatacttctgctaataattttctctgagagcatgcattgtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgccggtgtgcttgttttcattggcgcgctggatgaccgttttgatatcagcgtaaaaatccgtgccaccatacaggccgctgttggcattgttatgatggtgttcggcaagctttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagcctcgcaatctggtgctttgcgatgatcgccgccatcctgccatacatcatgcttaaccttggtatcctgggtcgccgctacaaagtctttatgggtgatgcgggcagtacgctgattggttttaccgttatctggatcctgctcgaaacgacccagggcaaaacccatcccatcagcccggttaccgctttgtggataatcgccattccgctaatggatatggtggcgattatgtaccgtcgcctgcgtaaaggcatgagcccattctctcctgaccgtcagcatattcaccatttgatcatgcgtgccgggtttacttcccgtcaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctatggattattggcatggggctggcgtttgcgttaatcgcgctggcgtatacgttttttgctcgtcaggagtggagctcgacggcgattaccgatcgtccaacggtgaatatgctggggggatattactcgcagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaacagcaaagccgatgcggcgttgctggatgaaatgattaacaacatccagtttatccccggagactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcgcgtaccatccagatgaaagctcaggtgaagcgtcaggaagaggtggcgaaagccatctacgaccgccggatgaacagcattgagcaggcgctgaaaattgctgagcagcataatatttcgcgcagtgcgacagatgtacctgccgaggaattacctgattcagaaatgttcctgcttgggcgtccaatgcttcaggctcgactggaaaatttacaggccgtcggtccggcctttgatctcgactatgatcagaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcgccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggcctgacagagataacctgtcggattctggaagggctaaaacctattcttgccgagttcaaaccagacgtcgtgctggttcacggcgatacgacgacgacgctggcaaccagcctggcggcgttttatcagcgtattcctgttggtcacgttgaggctggtctgcgcacgggcgatctctattcgccgtggccggaagaggctaaccgtacattgaccgggcatctggcgatgtatcacttctctccaaccgaaacttcccggcaaaacttgctgcgtgaaaacgttgcggatagccgaatcttcattaccggtaatacagtcattgatgcactgttatgggtgcgtgaccaggtgatgagcagcgacaagctgcgttcagaactggcggcaaattacccgtttatcgaccccgataaaaagatgattctggtgaccggtcacaggcgtgagagtttcggtcgtggctttgaagaaatctgccacgcgctggcagacatcgccaccacgcaccaggacatccagattgtctatccggtgcatctcaacccgaacgtcagagaaccggtcaatcgcattctggggcatgtgaaaaatgtcattctgatcgatccccaggagtatttaccgtttgtctggctgatgaaccacgcctggctgattttgaccgactcaggcggcattcaggaagaagcgccttcgctggggaaacctgtgctggtgatgcgcgataccactgagcgtccggaagcggtgacggcgggtacggtgcgtctggtaggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttatatcgggctgccaacggcagcagcgtttgcctcacggcaaaaacaggtaattggtgtcgatatcaaccaacatgcggttgataccatcaatcgtggcgaaatccatatcgtcgaacctgatttggcgagtgtagtaaaaactgccgtagaaggcggttttttacgagcgagcacgacgccagttgaagcggatgcctggctgattgctgtacccacgccgtttaagggcgatcatgagccagatatgacctacgttgaatcggctgctcgctccattgcgccagtgctgaaaaaaggcgcgctggtgatccttgaatccacctcgccggtggggtcaaccgagaagatggcagaatggttagcagagatgcgtccggatctcactttcccgcagcaggtgggcgagcaggcggacgtcaacattgcttactgcccggaacgcgtgttaccaggacaggtaatggtcgagctgattaaaaacgatcgcgtgattggtggtatgacgccggtttgttcggcccgcgccagcgaactgtacaaaattttcctcgaaggtgagtgtgtcgtcactaactcgcggacggcggaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgttaatattcttcagcctggccctggcgtgggcggtcactgcattgctgttgatccgtggtttatcgtggcacagaacccccagcaggcgcggcttatccgtaccgcgcgcgaagtgaacgatcacaaaccgttctgggttatcgatcaggtgaaagcggcggtggctgattgcctggcggctaccgataaacgcgccagtgaactgaaaatcgcctgctttggtctggcgtttaaaccgaatattgatgacctgcgcgaaagcccggcgatggaaatcgctgaactgatcgcccagtggcatagcggcgaaactctggttgttgagcctaacatccaccagttgccgaaaaaactgaccgggctttgtactctggcgcagcttgacgaggcgctggcaacggcagacgtgctggtgatgctggtcgatcatagtcagttcaaagttatcaatggcgacaatgtccatcagcagtatgtcgtcgatgccaaaggagtctggcgctgatgagaaaaattctgataacaggtggtgccgggtttattggctcggcgctggtgcgttatatcatcaacgaaacgagcgacgcggtggtagtggtcgataagctgacctacgccggaaacctgatgtcgctggcaccggtcgcgcaaagcgagcgctttgcctttgagaaagttgatatctgcgatcgggcagaactggcacgcgtattcactgagcatcagccagactgtgtcatgcatctggcagccgaaagccatgttgaccgttctattgacggcccggcagcgtttattgaaaccaacattgtcgggacttatacattgcttgaagcggcgcgggcttactggaatgcgctgacggaagataaaaaatcagcgttccgttttcatcatatctccactgacgaagtatatggtgacctgcactcgacggatgatttcttcaccgaaaccacgccgtatgcgccgagcagcccttattccgcgtcaaaagccagcagcgaccatctggtgcgcgcctggctgcggacctatggtctgccgacgcttatcaccaactgctcgaataactacggcccttaccactttccggaaaaactgatcccgctgatgatcctcaacgcgctggcgggtaaatcgctgccggtatatggcaacgggcagcaaatccgtgactggctgtatgtggaagatcacgcccgcgcgctgtattgcgtggcgaccaccgggaaagtcggtgaaacctataatattggtggtcacaacgagcgtaagaatctcgatgttgtggaaaccatttgcgagctgctggaagaactggctccgaacaagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggttcagtggtatctggctaatgaaagctggtggaagcaggtgcaggacggcagctatcagggcgagcgtttaggtctgaaaggctaattttcagcggaggcaaacatgaaaggtattatcctggcgggcggttccggcacccgattgcatccgattacgcgcggcgtatcgaagcaactgttgccgatttacgataagccaatgatttactatccgctgtcggtgctgatgctggccggtatccgcgaaattctcatcatcactacgccggaagataaaggttatttccagcgcctgctgggcgatggtagtgagttcggtatccagctggaatatgccgaacagcccagcccggacggtctggcgcaggcctttatcatcggtgaaaccttccttaatggtgaaccttcttgtctggtgctgggcgataacatcttcttcggtcagggcttcagtccgaagctgcgtcatgttgcggcgcgcaccgaaggggcgacggtttttggctatcaggtgatggacccggaacgctttggcgtggtggagtttgacgacaatttccgcgctatctcgctggaagaaaagccaaaacagccgaagtcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaagccagcacctttgtacagacggtggaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgccctgcaacagctgggattctccctggtagaaggtgaagttgatttggcgctacccgtgaacaatgccagtgatagcggtgctgtagtggcacaagagaccgatattcccgcattacgtcagttagccagcgccgcatttgcgcaaagccgttttcgtgcgccgtggtatgcgcctgacgccagcagtcgcttttatgcacagtggattgaaaatgccgtgcgcggcacctttgatcatcaatgtctgattttacgtgcggcgtccggcgatattcgcggctatgtctctttacgggaactcaatgcgacagatgcgcgaattggcctgctggctggacgcggtgcaggtgctgagctgatgcaaacggcgctaaactgggcgtatgctcgcggtaaaacaactttgcgggtggcgacccaaatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatttgtttgtggtagaagatgccgctcagggcgtgatgtccacttacaaagggcgtgcactgggaaccattggtcatattggctgctttagcttccatgaaaccaaaaactacacggcgggcggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcatacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttttcctgatatgtcgttggcaaaagcgtccttgtggacggcggccagtacactggtcaagattggtgccgggttactggtcggtaagttgctggcggtgtcatttggtccggcggggcttgggctggcggcaaatttccgccagttgattaccgtgctcggcgtgcttgccggggctggcatctttaacggtgtaaccaaatacgttgcccagtaccatgataatccgcaacagctgcgccgcgtggtcggcacttcatcagcgatggtacttggtttctctacgctgatggcgctggtttttgtgctggcagctgcgccaatcagccagggattgtttggtaataccgactatcaggggctggtgcgtttagtggcgctggtgcaaatggggatcgcctggggcaacctgttactggcgctgatgaaaggctttcgcgatgccgcaggtaatgcgttatcgctgattgtcggcagcttgattggcgttctcgcgtactacgtcagttaccgtttgggcggttatgaaggggcgttgctgggtctggcgctgattcccgcgctggtggtaattcctgccgccatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaggtggggatctggcaaggggtgagcagtatttccgatgcctacctgcaatttattacggcatcgttcagcgtatatttgctgcccacgttgtcgcggctaacggaaaagcgcgatatcacccgggaagtggttaaatcgctgaaattcgtcttaccggcagtggcggcggcgagttttaccgtctggctgctgcgtgattttgctatctggctgctgttgtcgaataaatttaccgctatgcgcgatctctttgcctggcagttagtgggtgatgtgttaaaagtgggcgcttatgtctttggttatctggtgatcgccaaagcgtcactgcggttttatattctggcggaagtcagccagttcactttattgatggtatttgcccactggctaatccctgcgcatggtgcactgggcgcggcgcaggcatatatggcaacttatatcgtctatttttctctttgttgtggcgtgtttttactctggcgtaggcgggcatgactgtactgattcacgtactgggatcggatatccctcaccataaccgaaccgttttgcggtttttcaatgacgcgctggccgcgacgagcgagcacgcgcgcgagtttatggttgttggcaaggacgacggcttaagtgatagctgtccggcgctttctgtgcaatttttccctgggaaaaaatcgctggcggaagcggtcatcgcgaaagcaaaagctaaccgtcagcagcgttttttcttccacggtcagttcaatcccacactgtggctggctctgctgagtggtggcattaagcccagccagtttttctggcatatctggggggcagacctgtatgagctttccagtggcttgagatataagcttttttacccactacgtcgcctggcgcaaaagcgagtcggctgtgtatttgccacccgcggcgatttgagcttttttgccaaaacgcacccaaaggtgcggggcgaactgctgttcttcccgacgcggatggacccttcgctcaatacgatggcgaacgatcggcaacgtgaagggaaaatgaccattctggtggggaactccggcgaccgcagcaatgagcatattgctgccttgcgcgccgttcatcagcaatttggcgatacggtaaaagtggtggtgccgatgggatatccgcctaataacgaagcgtacattgaggaagttcgtcaggcggggctggagttattcagcgaagaaaatctacaaattctgagcgaaaaactggaatttgacgcctatctggcgctacttcgtcagtgcgatcttggttactttatttttgcccgccagcagggcattggtacgctgtgcttactgattcaggcgggcattccttgtgtgcttaaccgggaaaatccgttctggcaggatatgacggaacaacatttgccggtgctgtttactaccgacgatctcaacgaggatattgtgcgtgaagcgcagcgccagttggcgtcggtggataaaaacaccattgccttctttagccctaactatctacaaggctggcagcgggcgttggcgattgccgccagggaggtcgcatgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggcttcccgctgaccagcgtgctggtatttcgctttgatgttggtgtcgcgccgccagaaatcttgttgcaggcgttgctttctgcgggctgcttctacgcggtttactatgtcacctacaaaacccgcctacgcaaacgcgttgctgatgtaccgcgccgtccgctgtttaccatgaaccgcgtggagaccaatcttacgtgggtgatcctgatgggtatcgcgctggtaagcgtcggcatcttcttcatgcacaacggctttttgctgttccggcttaactcctacagtcagatcttttccagtgaagtctccggcgtggcgttaaaacgcttcttttactttttcatcccggcgatgctggtggtctactttctgcgccaggacagcaaagcgtggctgtttttcctcgtcagcacggtcgcctttggcttgctgacttatatgattgtcggcggcactcgcgccaatatcatcatcgcattcgctatcttcctgtttattggcattattcgcggctggatttcgttgtggatgctggcggcggcgggcgtgctggggattgttggcatgttctggctggcactaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactcagccaactactttacctgggaagtgctgaataaccactccggactggcgatctcgcctacgcttataggctcactggtggtgatgggcggcgcgttgttcatcccgctcggggcgatcgtggttggtctgatcatcaaatggttcgactggctgtatgagctgggcaaccgcgagcctaatcgctataaagctgcgatattgcacagtttctgctttggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgtacaaaatcatcgctccggacgcaggttgaaggataacaatgaataacaacaccacggcaccaacctatacgctgcgtggcttacagttgattggttggcgtgatatgcagcacgccctcgattatctgtttgctgacgggcagcttaagcagggaacgctggttgccattaatgctgaaaaaatgctgactattgaagataacgccgaggtcagggagttaattaacgctgccgaatttaaatatgcggatggcatcagcgttgtacgttcagtacgtaaaaagtacccgcaggcgcaggtttcccgcgttgccggtgccgatctctgggaagagctgatggcgcgcgcaggcaaagaagggacgccggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggtgcgcaaatcgtcaccgttgcgatgggatcgccaaagcaggagatcatcatgcgcgactgccgtctggtacatccagatgcgctgtatatgggcgttggcgggacttacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcactacaccggcaacctatgattttcctctctttgtaaagcgacggagtggtcactccgtcgcctgtctgcttttttattacacaaagcattcaaatttttaatgctttatttgccatttctcctgaattacgaaaacatttgcaacactcgatgtacccataacgataaccggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttatgcgcatcgttatatgagcccgttctttggctatctcaccgcctggtcttactggtttatgtggatggcggtggggatctctgaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaggtgctgtggcggatcctgattttctacgtaggcgcgattttcgttatcgtcaccatcttcccgtggaatgaaataggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaattacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataagcagcaaaacgcacaaaccgtaaccaaacgcgcaatttatttaaaaagggactagacagaggggtgggaagtccgtattatccacccccgcaacggcgctaagcgcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcaccctcccttcgcaataaacgcccgtaataactcattgccccacggtatgatttcgcccttaacgtattgaaggatgacttcaggcaaggagcgaccatgctgcaacaggttccaacgcgtgcttttcatgtgatggcgaaaccgagcggttccgattgtaatctgaactgtgactactgtttttatctcgaaaaacaatccctttaccgcgaaaagccagtcacgcatatggacgatgacacgctggaagcgtatgtccgtcactatatcgctgccagcgaaccgcaaaacgaagtggcttttacctggcagggcggcgaaccaacgctactcgggctggcgttttaccgccgtgccgtagcgctacaggcgaaatatggtgctggcaggaagataagtaacagcttccagactaacggcgtgctgctggatgacgaatggtgcgcgtttctcgcggagcatcattttcttgttggtttatcgctggatggcccgcctgagatccacaatcaatatcgcgtgactaaaggtggcagacccacgcataagctggtgatgcgtgccctgacgctcctgcaaaaacatcatgtcgactataacgtgctggtctgcgttaatcgcaccagcgcgcagcaaccgttgcaggtatatgattttttgtgcgatgcgggagtcgaattcatccagtttattccggtggtcgagcgcctggctgatgaaacaactgcccgcgatggacttaagttacatgcgcctggtgatattcagggtgagctaacggaatggtcggtgcgccccgaggagttcggtgagtttctggtggcgatattcgaccactggatcaaacgcgacgtcggcaagattttcgtgatgaatatcgaatgggcgtttgccaattttgtcggtgcgccgggtgcggtttgccatcatcagccaacctgtgggcgctcggtgattgttgagcacaacggcgacgtttacgcctgtgatcactatgtttatccgcaatatcggctggggaatatgcaccagcaaacaattgcagaaatgatcgattccccgcaacagcaggcgtttggtgaagataaatttaagcagttaccggcgcagtgtcgcagttgtaacgtgttaaaagcgtgctggggaggctgcccgaaacaccgcttcatgctcgatgccagcggcaaaccgggactgaattatttgtgtgccgggtatcagcgttatttccgccatctaccgccatatcttaaagcaatggctgatttgctggcgcacggtcgcccggccagcgacattatgcatgcgcatttgctggtggtgagtaagtagaaatcggcggccgcctgcggttgattgccggatgcggcgtaaacgccttatccggcctacatgatcgtgcaaattcaataaattgcagcgttctgtaggctggataagatgcgtcagcatcgcatccggcaaaggcagatctcagcgatagcgccggcttagtcagatttaatctgcgcgcgtggtggatattttttcaggatctccatatacgcgtgcatttcggtctgtagcggtacacccatcggaatatggcgcacgccgatggagtcgctttcctgcggatcggtgtagaggttaaacaccgacgatcccgccgtttgcattactgtgccggtgaatccaccctgatatccgctctgggtataagcgtaaggttgctgaatcaggacgtgatacttgaactcatccatacgcacagcagcgagtttaccgttgaggaagtagtgctcggccttacggttagactgaccatttgttcccaggaagaaggatgtctggtccacaccatcgataaaggtggttttcggcactaaattcgccactttcgctccaggatgccctgccagatccagcgcggtagggaagagatctgccagatcgacaataccgtcagatttacgcggttggatcatccctttccagtaaacgaaagtcggtacgcgaacgccgccttcccaggtcgaacctttcgcaccacggaacggggtgcgtccgtgcggcggtacttcggcttccggtccgttatcggaggtaaagacgatcagcgtgttatcaagctgaccgtttttctccagtgttttatacagattagcgaacacatcgttcatctccaccatgcagtcgccatacgaggtgcgtgccggagagctacccgcatatttcgcatttgggtagttatcgaagtggcagccacgagtgccgtagtagaggaagaatggtttatcgctcttcgccatcttgtcgaggaacttaacgccatagtccatccagcgttgatccagatcttccatatatttcggcgtaatgtcggcaatggcctgttgttcgccgccgcgcaccgcatgaacgtcatctttgctgaacggtaattgcttgatgtattcagaacggtccggactcagggccacttccggattgacgtgaacgtcgcgccattcggtgtacatatcagacaccgagttaaagccacggaaatcatcaaagccaacgttctgcggctgcgactctttgttttcccccatatgccattttccgatggcctgagtgacgtagccctgatcgtgcagcaactgcggcagcgtggttaacccttgcagcccgcccggttgcccgtacattggcggcatcagaatgccgtggtggatggagtattgtccggtgagaatggtggcgcgggttggggaagagcttggttgagaatacgccgaagttaaaatcagcccctggctggcaacggcgtcgatatctggtgtagggttacccaccgccacgccgccaccgttaaaaccgacgtccatccagcccacatcgtccagcaagaaaacaaccacattcggtttcttaccggtttttttctcaagttctgccagcttctgctgggtttctttatcctgcgccggatgctgcattactggcatcatattgtcggcaatagtggtcgccggtttaaccagatactggtttgggtgatcgtatccggcaaagcctttgcgtgcggtggcagttgacggggtatctgctgcgctggccatgagaggaagagcggcggcgacagcaacaacaagacgtttgggtgaaaacgaaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtaaggcaggtttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcccgattctctgtggcataataaacgagtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatgtatcaggaaggccccggaggtgcttgcctccgggtgagaaggaactactgtggcgggttattctgcaacgttaacatcaaaccgtcgcgacgcatagctgcagcttcttccggcttgtgcagtctgtccagcgcgtcggcaagccatgcgtaatcgtaggcgtccggacgttgtttcagcgctgcgcggaaggcgagcgatgcttcctgccattctccgtgcttcatcagtgactggcccagtgtgctccacaacagcgggcgatcgccgacgtttttgatttgctggcgcagcactttttccagctgttccggattgtttgttttcagtcgaggaatcggcagcagtaggcgatcgtcgtactggcgtttcaggccatcgatgataatttgctgggcagtatcatgatcgtcacattcaataagatgttccgccattgccacctgcaacgctacctgatgacgcgttttccggctttggtttttccaccagttacgcaaaccttcgctaccgttatcggcacgcgcctgatccatcaggccaatccatgcctgttgttccagcattgcacgatgttcttcatcaccaacatgggctttcgccattgatgggataatatccagcagcgaactccatgcacctgtgcggatatacgcctgttccgccagacgtaatacttccggatggcgtggcgtaacttccagcagcttatccacgccgtggcgtgcagcatggttttcattacgggccagttgcagacgtacgcgggtgatttctaccggaatggtgtcgttgccggccagctccgctgcgcgttccagatgttggttggcgcgtgcttcatcaccacgttgttgcgcggcttcggcagccagtagatagttcaccaccggttgttccgcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgccagtgcggaagatccgccgcagtagccactcaatggcaaacagcactaccatcgccagaatcaatatgatcgccaggcccgtgacgctggtttcgatattgtagttgtcggtctggatcagcacataaccctgatggccggcaatcatcgggccaaccacgatccccgcaatcagcaacacaaagagcaataacacttttagcatggttattctccttgcggcgcggctgccggagtatcagcttgcggtgcaggtgcaggtttagcttccgttgtccccgctgccggttgtgccagcaggttacgcacgcgagtctgcatcagtttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtctgaatccatcggcgaaccatcgctgtcattatcggccagacgcaggttatctacctgatttgaaagctgattaagcttaaggatgatgccgtcataatccacctgcgatactgcagaaaggctggcgatatcatcggtaattgcccgacgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgagccagcagccaggttttagcatcgctgccggaaatggtggcgaccttttgttggacttcatccaactgttttgccagcgtttcttgctgacgattcgcctgcttaagttgtgcagcttgttgcttaataatgccttccagctcggctttttggctctcctgggctttttgcaatgccgtcagttggttagccagggcatcgctggtggcggtctgattgacggcctgttgtttaccccagccatacaaaccgatgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagtgtagtaaccagtgctcacgataccattgtgggatcagcgaccagagttgctgcaacatttcaccgctggtaacaacgaccatcgtcacctcgcgggcttgccagcgcatcgcttcttctgcaccatcgtaatggattgcgcatcgttgataacattcacaaaaagtgacctcagcaccgcgcgccgtcagggtatccccaattagctcacgaccaccattgccacgtaatatcagcgcacgtttgcccgcaatattttgtaattcaggtaattgtagcaagacttcgctgatttcccgatcctgcgggtagagaatcttctgtccacttacggtatgtagtgccagtgcggtggtgcgtccaatggcgaaataatcaggtagtcggggccatttacgatcttgctgatgcagctgtgattgggcaaaagcaaccgcgtgttgcgagagggcaaacaacagatcgctctcccccagcgctgccagttgatcagcaagttgcggtaattgttgacccggagaaaactcaatcagcggaaaatgccaggccacctgccccagtgtgcgcagacggctcactaactcttctccagcgggagacgggcgggtgacaaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccagcgcacgcagccagatttcgccatcaataagctcggcgtagctaccaattggcacctgacatccgccttcgagacgggtattcatggcgcgttctgcggtaacgcgcagtgcagtttcgtggtgattcagcgcggcaagcagctcgcgagtgcgtgaatcatcaaggcggcattcaatacccaccgcaccttgtcctaccgccggaagagaaatctcgggtggcaacgcggcgcgaatacgtgactccagacctaaacgttttagtccggctacggcaagaatgatggcatcgtattcgccgttatccagtttgctcaggcgagtgccgacgttgccgcgcagggagcggataatcagatccggacggcgttcagccagttggcactggcgacgtaaactggacgtcccgacgatactgcctgccggtaacgcatccagactgtcatagttattggacacaaaggcatcgcgaggatcttcacgctcacaaatagtgaccagtcccagaccttgcgggaattcaaccggcacatctttcattgagtgtacggcgatatcggcgcgattttcgaggagcgcgacttccagctcttttacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagtgatgtcagtgttgtggtgaaacgtagacgcctgcgcaaaccgtaaaatgaggtctggcagtggatcctgacaggcgtttcacgccgttgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggatccgccgaaaggtgagcttccaattactggtgtatacaccatgggcagcacctcgtccgtagggcaaagttgttcctctgacctggatatctgggtctgtcatcaatcctggctcgatagcgaagagcgccaattgctacaacgtaaatgtagcctgctggaaaactgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccacgtctgctggcgaaagatatcaaacagcgtttgcacgacggcgagattgtatcgtttggtctcgatccatactgcatgatgctggagcgtgttactgaatacctgacggcgattgaagattttacccgtctggatttagtacgtcgctgcttctatttaaaagtgtgcgaaaagctcagccgtgaacgcgcctgcgtaggctggcgtcgcgcagtgttgagccagttagtgagcgagtggggttgggacgaagctcgtctggcaatgctcgataaccgcgctaactggaagattgatcaggtgcgtgaggcgcacaacgagttgctcgacgcgatgatgcagagctaccgtaatctgatccgctttgcgcgtcgcaataaccttagcgtctccgccagtccgcaggatatcggcgtgctgacgcgtaagctgtatgccgcgtttgaagcattaccaggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgtttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagcggcgttccgcaatcaggtggtgcatttcgatttccgtaagctggatgtcttcagctttggcgagaatcaaaattgcctggtaggtagcgttgacctgctgtaccgcaactcgtggaacgaagtgcgtacgctgcacttcaacggcgagcaatcgatgatcgaagccctgaaaactattctcggcaaaatgcatcaggacgccgcaccgccagatagcgtggaagtcttctgttatagccagcatctgcgcggcttaattcgtactcgcgtgcagcaactggtttctgagtgtattgaattgcgtctttccagcacccgccaggaaaccgggcgtttcaaggcgctgcgcgtttctggtcaaacctgggggttgttcttcgaacgcctgaatgtatcggtacagaaactggaaaacgccatcgagttttatggcgcgatttcgcataacaaactgcacggcctgtcagtgcaggttgaaaccaatcacgtcaaattaccggcggtggtggacggctttgccagcgaagggatcatccagttctttttcgaagaaacgcaagacgagaatggctttaatatctacattctcgacgaaagcaaccgggttgaggtatatcaccactgcgaaggcagcaaagaggagctggtacgtgacgtcagtcgcttctactcgtcatcgcatgaccgttttacctacggctcaagcttcatcaacttcaacctgccgcagttctatcagattgtgaaggttgatggtcgtgaacaggtgattccgttccgcacaaaatctatcggtaacatgccgcctgccaatcaggatcacgatacgccgctattacagcaatatttttcgtgatgaacgtgccggaaagcgaggcttatccggcatgcaatcttagcggaaactgactgtttcacccgcctgctgcgtcgccgcctgttccagcaaatcccagaaggtttcgccgctgcgatcacaaatccactcatcgcctttcaggtcaaaatggtagccgccctgtttggttgccagccatacctggtgcagcggctcctggcggttgataatgattttgctgccattctcaaaggtaatggtcagtacgccgccgttgatttcgcagtcgatatcgctgtcgccatcccagtcgtccaggcgttcttcaatggtcagccagagttgatcagccaggcgatgaaattcactgtcgttcattgttgtatcctgtttttaagtgatggcggcagtatagcggcatggggtcagggcttcaaagtttgcacctctgcggctgcgttccggcacgattcatccgtcaccggaataatgatgtctctgtgtagcgaaagatttgtctcttcattagggcgcagttacaccacgtctttccctgtttctggtaaacattatgatcaggtttaccgagcgagcatcctcacgctgacggaactaaaaaagacaacaaacaaaccacattgcgatagtgcataaagccatcctggcgcgaggtgccgatcacgaaactaccagcaaaacataaatccccacgagtaagcgttatactcgcagcatttcctcacttttcagacttcataaagagtcgctaaacgcttgcttttacgtcttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggataaaaacgatcgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgtaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggctatcgccaacgaaggcctgttttatcgcctactctacctgcagcgcagtctcaccgccgccagcagtctcgacgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtttggggcaggaacagcactatcttgggccgcttaacggaccagagctgctggtggtgctaccggaagcgaaagcggtgggatcggtggcgatgtcgatgctgggaagcgatgctgatttgggtgtcgtgctgtttaccagtcgcgatgccagtcactatcaacaagggcaaggaacgcagttacttcatgaaattgcgctgatgttgccggagcttctggagcgttggattgaacgcgtatgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacacgcagcaatgatcaactttgccaaatggcgcagccgaatcgacgtcccgcagcaaactcacgacaccttaaaacagctggcgaagaaatggccgctggtggcgatcaccaacggtaacgcccagccggagctgtttggtttgggggattattttgagtttgtgctgcgcgctggcccgcacgggcgctcaaaaccgttcagcgatatgtactttttggctgcggaaaaactcaacgtgccgatcggcgagatcttacatgttggggacgatctcaccactgacgtgggtggggcaattcgcagcggaatgcaggcttgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccatactcgattatggcggtgacgtttaccaacaaagcggcggcggagatgcgtcatcgtatcgggcaactgatgggcacgagccagggcggtatgtgggtcggcaccttccacgggctggcgcaccgtttgctgcgtgcgcaccatatggacgccaatctgccgcaggatttccagatcctcgacagtgaagaccagctacgcctgcttaagcgtctgatcaaagccatgaacctcgacgagaagcagtggccgccgcggcaggcaatgtggtacatcaacagccagaaagatgaaggcctgcgtccgcatcatattcaaagctacggtaatccggtggagcagacctggcagaaggtgtatcaggcgtatcaggaagcgtgtgaccgcgcgggcctggtggacttcgccgagctgctgctgcgcgctcacgagttgtggcttaacaagccgcatatcctgcaacactaccgcgaacgttttaccaatatcctggtggacgaattccaggataccaacaacattcagtacgcgtggatccgcctgctggcgggcgacaccggcaaagtgatgatcgtcggtgatgacgaccagtcaatctacggctggcgcggggcgcaggtggagaatattcagcgtttccttaatgatttccccggtgccgaaactattcgtctggagcaaaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgatgaagcgcgttttgtggttaaccgcatcaaaacctggcaggacaacggcggagcgcttgccgagtgcgccattctctaccgcagcaacgcccagtcgcgggtgctcgaagaggcgttattgcaggccagtatgccgtaccgtatttacggcgggatgcgcttcttcgaacgccaggaaatcaaagatgcgctctcgtatctgcgcctgattgccaaccgcaacgacgacgcggcctttgagcgtgtggtgaatacgccaacgcggggtattggtgaccggacgctggacgtggtacgtcagacatcgcgcgatcgccagttaacactctggcaggcatgtcgtgagctgttgcaggaaaaagccctcgccgggcgagctgccagcgccttgcagcgatttatggaattaatcgacgccttagcgcaggaaactgccgatatgccgctgcatgtacagactgaccgggtaattaaagactccggcctgcgtaccatgtatgagcaggagaagggcgaaaaaggtcagacgcgtatcgaaaacttagaggaactggtgacggcaacgcgccagttcagctacaacgaagaagacgaagatttaatgccgctgcaggcgttcctctcccatgcggcactggaagcaggtgaagggcaggcggatacctggcaggatgcggtgcagttgatgacgctacactcggcgaaaggcctggagttcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctgtatggtaaagaggtttaccatcgcccgtcgcgctttatcggcgagctgccggaagagtgtgtggaagaggtgcgcctgcgcgccacggtaagccgcccggtcagccatcagcggatgggtacgccgatggtcgagaacgacagcggctacaagctcggccagcgcgtacgccacgctaagtttggtgaaggcaccattgtcaatatggaaggcagcggtgagcatagccgtttgcaggtggcatttcagggccagggtattaaatggctggtggcggcatacgcccggctggagtcggtgtaacgttgccggatgcggtgctgcgcaccttatttggcctaaaaaatcattcagattcaataaattgcaacgtcatgtaggccggatagggcgtttacgccgcatccggcatctgcgccatcttcagtatctgacacaaaactatcgttttaacctttccgctcgacggaaatcatggtgacaaaaggatagcgttgccacgggattgccccgcctttcatatacatatgtgaaatcgtgccatcaagataaagcagctgctcaacgttcagtttcgctttggcataacaggcaaaatcataaaaatttgttgcctgctggctcaacaaaaacacggcgttcccatgtttattaatcccaacaccgttacgaattttgcttgaggcgacgttgggatgaatacgcggattaattacaccgttttccatcaacattggccctgactgcaccgcaaactgaatctctttactggttttgaaggcatccagacgaacgatgccgactttatctcccgcgacataaaacacgccgccaggacggataaagaaattcccttcacctgaagcgagatttaacgccaccttctgctgaccgttttcgatgtacaaaccgagcggcgcatagctttcatcatagatgccgccgttcatcgccatctgcacctgaccctgactattaatatccgccagcagagcatgtaacgttccccacgcttcgccattggctttttgccagtacattttcacccgctctgtttgaggattaacggtatacgcctgtacggtcagcgtcggatctgagagtgcgcaatcatcagcggcaacagcaaacaagggaagtaaggtgagggcgagaaaaatccgtttgagattcaaggtgatcattcctttaccaatgagtagctgatgcgccattataggtcctggatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcactatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgacgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcgatggtagacggtaacgcctacgagttgctgctggatctgttcgaaaccaaaatcgaacagttggcagatgaaattgaaaatatctatagcgacctggagcagttgagccgggtgattatggaagggcatcagggcgatgagtacgacgaggcgctctccactctggcggaactggaagatatcggctggaaagttcgcctgtgtctgatggatacccagcgcgcgctcaacttcctggtgcgtaaagcgcgtttaccgggtgggcaactggagcaggcgcgtgaaatcctgcgagatatcgaatccctgctgccgcataacgaatccctgttccagaaggtgaacttcctgatgcaggcggcaatgggttttatcaacatcgagcagaaccgcatcatcaaaatcttctcggtggtatccgtggtattcctgccgccgacgctcgttgcttccagctatggcatgaactttgagtttatgccagaactgaagtggagcttcggctaccctggcgcgattatctttatgatcctcgcgggcctggcaccgtatctgtactttaagcggaagaactggttgtaaaaaacgagagcggtggcttagtctggctaagccacctgttattcaaaggctccaggtatttaacccttttacctctttctcatagaaccatttgttcgtgttaacagcaacataggctgctacggcaattcccagaatgttaacgccaattagtgcaccaacaaatagagatagaataccaagtaatagaactataattgcttttttccataaccccaggacaaataaatatatccaggaacagaagaaagcaatgaaattcatttgaatagttaagcgttgtcttacttttaatgctttaaatgctgctttatattctggtgttgccccccagaatccaggaaaaccatgttgatcataaaaattaaatcggtatttccatttttcacttaatgaaccatcgttcatatattccttactcataaatactccataactattgttttgatgaatcagtaggtgcaagcattagcatactgaaagtggaaaaataacaaatcaaaaaaatcatcgaaccattgcctgaacaggcaaaatcttcggctatcattgtgatgatagagatgatatatactgctaatgtaccaaaaacataagtttttatatagatgaaaccactatcacggagtcgctggcaattcatgttgatgacgagataatggagtacgatggtagagactataacaagaaagcctgcttctccatcgttaaaaaagataataagaaaggcaaaaatgaaatttattaaaataaatgaaaatatataacgacgtctggaaatcttaccgttagatgttgggataaatatacgtaacataaattttacatccttgtatgagtctccggtcagcatggcaatatgcccactctcatgcaagagtcggcatattttttcagaatatatttattttttatttggacgttctacgctgcgtataaatcgcatccatcacaaaaattgccagcgccacccaaataaaggcgaaagtcaccatcttatcggcacccggtttttcaccataaaacgtcacagccagcaggaacatcagcgtcgggccaatgtactggaaaaagcctaacgttgagagacgcaagcgcgtggcagcggcggtaaaacacaacagcggtacggtagtgacaataccggcggcgatcagcagtaaattcagcgacatcgggttttgccccatatggctggttgagctgtcggcaatagcaaacaggtaaattgccgccacgggcagcagccacatggtttcgattaacatgccggtttgcgcttcaacggcaatcttcttgcgtaccagaccgtagaaggcaaaactaaatgccagtcccagcgcgataataggtagcgaaccaaaagtccacagctggactaacacgccacatatcgccagaatcaccgccagccattgcatccggcggaatcgctcgccgaggaaaatcatccccagcacaatgttcaccagcgggttaataaagtaaccaaggctcgcttccagcatatggtgattgttcaccgcccagataaacagtagccagttgccaccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatttcatcggcgggcacgtagtaaatcaacttgaagtacgctggcgctataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgcacgcaacaggctactagtagcagtaaaacgctcgcccctgcctgggcgcagataatcaacgcgaagatcaatggtccccatccgcgatagccgctggcgtagttcatcttcactgatggtttcgtggcgggttaaggtacttcccacgcacaccagaccggcggcgacatccagcgccgacgcaatgaccccgccgtgcaaaatgctttgcgcccagttgcccaccatcattggctgatttttaaaggccagctgtgcgaactctttttcgtaacgctccagttccatccccaatgcgcggttaaatggcatgtgataaacaaacatctcacccactaatttcagggcttgttcagcggtcagtacggcagacatatcatccttacacttcattggttaatgaaatgttgattttatgcttctttgttgttggtttctactttaggaagggataactaacggctatggagttaagtatgtaaaatagcccgcagaaaaatattcaccttatcaataattcgttacggagaacacgaccgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttgatgaacggttgagtggttggcaaatctggaatccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagaaattatcgacactgtgctttccggccgcgattgcctcgtcgtcatgcccactggtggcggaaaatccctttgctatcaaatccctgccttattgctaaacggccttaccgtggttgtttcaccgctgatttcgttgatgaaagatcaggtggatcaactgcaagccaacggcgtggcggcggcgtgccttaactcgacgcaaacccgcgaacagcaacttgaagtgatgacaggctgccgcaccgggcaaattcgtctgctttatatcgccccggaacgcctgatgctggataactttcttgagcatctggcgcactggaatccggtgttattagccgttgatgaagcgcactgtatctcccaatggggccacgatttccgcccggaatatgccgcgctcggtcagttgcgccagcggttcccgacgctgccgtttatggcgctgaccgccacagccgacgacaccacgcgccaggatatcgtgcgcctgctggggctgaacgatccgctgattcaaatcagcagttttgaccgtccgaatattcgctacatgctgatggagaagttcaaaccgctcgatcagttgatgcgctacgtgcaggaacagcgcggtaagtcaggcattatctactgcaacagccgcgcgaaagtagaagacaccgctgcgcgcctgcaaagcaagggaattagcgcggcggcctatcatgccgggctggaaaataatgttcgcgccgatgtgcaggaaaaattccagcgcgatgacctgcaaattgtggtggcgacggtggcgttcggcatgggcatcaataaaccaaacgttcgcttcgtggtccactttgatattccgcgcaatatcgaatcctattatcaggaaaccggacgcgccgggcgtgatggcctgcccgcggaagcgatgctgttttacgatccggctgatatggcgtggctgcgccgttgtctggaagagaagccgcaggggcagttgcaggatatcgagcgccacaaactcaatgcgatgggcgcgtttgccgaagcgcaaacttgccgtcgtctggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgtggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggccgcgcgcccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgatagccgatgaaagtaatgtcccgccgtacgtggtgtttaacgacgcaaccttgattgagatggctgaacagatgccgatcaccgccagcgaaatgctcagcgttaacggcgttgggatgcgcaagctggaacgctttggcaaaccgtttatggcgctgattcgtgcgcatgttgatggcgatgacgaagagtagtcagcagcataaaaaagtgccagtatgaagactccgtaaacgtttcccccgcgagtcaaatgtatgttgatgttatttctcaccgtcgccatggtgcacattgtggcgcttatgagccccggtcccgatttcttttttgtctctcagaccgctgtcagtcgttcccgtaaagaagcgatgatgggcgtgctgggcattacctgcggcgtaatggtttgggctgggattgcgctgcttggcctgcatttgattatcgaaaaaatggcctggctgcatacgctgattatggtgggcggtggcctgtatctctgctggatgggttaccagatgctacgtggtgcactgaaaaaagaggcggtttctgcacctgcgccacaggtcgagctggcgaaaagtgggcgcagtttcctgaaaggtttactgaccaatctcgctaatccgaaagcgattatctactttggctcggtgttctcattgtttgtcggtgataacgttggcactaccgcgcgctggggcatttttgcgctgatcattgtcgaaacgctggcgtggtttaccgtcgttgccagcctgtttgccctgccgcaaatgcgccgtggttatcaacgtctggcgaagtggattgatggttttgccggggcgttatttgccggatttggcattcatttgattatttcgcggtgatgccagacgcgtcttcagagtaagtcggataaggcgtttacgccgcatccgacattatttttcacgcatgcctcgccgatgctaacagcgctcccaccagcataaacaacgagccgaaaatcttattcagcgccttcatctgctttggtcctttaatccatagagcaatccgttgagcaagggtggcgtaaccgatcatcacaataatatcgaccacaatagtggtgacgccgagcacgatatactgcatcagttgcggctgttgcggcatgatgaattgcggaaatagcgccgccagaaacacaatacttttgggattggtgagattcacaaaaactgcgcgctggaacaaatgtcgacgcgattgagtagaggccagcgatttaaggtcaattgcaccagcggcgcgccactgctggattcccagccaaatcaagtaagccgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatagtgttgattgcaccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgctaaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggtgcgcgcgttcacgatctggatggtaatctgatttttgctcataacctggatcgcgacattgccagcgatctgtttggcgtagtcaacgacaatccggacatcattactaacgtttatcgcgacgacgaatggtttatgaatcgccatcgcccggaagagatgcgcttttttaaagaagcggtgttccaatatgcgctgtatgagcctggattactggagccggaaggcgtcagcaaagtgttcttcacctgcgattcccatgaacaactgctgccgctggagcaggcgattaacgctcgttggggcgatcgcgtcaacgtcagtttctctaccttaacctgtctggaagtgatggcgggcggcgtttcaaaaggccatgcgctggaagcggtggcgaagaaactgggctacagcctgaaggattgtattgcgtttggtgacgggatgaacgacgccgaaatgctgtcgatggcggggaaaggctgcattatgggcagtgcgcaccagcgtctgaaagaccttcatcccgagctggaagtgattggtactaatgccgacgacgcggtgccgcattatctgcgtaaactctatttatcgtaatcgttctttatttggtcagttgtcaacctgatacttcgctacaatggatacccgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagcttggcgtgatgtatatgctgagtttccgcgcttatctctacctgacggtttccgagctgctgctgttcaccgtgctgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttgctgctggtgcaactctccaatatcacttttgccattggcatggtgggttacaaacgcctgatggaaactcgcccgatgccacagcataacgcctttgcgtggttctatcttggcgcgtttctggtggcagtgattgcatggttcttgctgggaaatgcgcagaaaatgccgcaaaccacgctgcaatggggcattctggtgtttcttggcgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgagcgaataaacgcttccgtaactggctgacgctgctcgccatcgcgcacggcggcgtacagtcggctccacaagccttcgcccagggttttggtcaccaccagaccctggcgctcaaaactctctactacccaatgcggtagcgcggcaatacccatccgcgcggcaaccatctgaatcaacaataaggtgttatcgacgcttttcagtgacgggctgacgcctgccggctgaagaaaatgccgccagacatccagtcgactacgctgcaccggataaattaatagcgtctcgctggcgagatcttccggtgtaattcgcgttttcgccgccagtggatggtcaggtgctaacaccagacgcacttcatagtcgaacatcggcgaataatgcaggccactgcgcggcagaatatcggacgtcattaccagatccagctctccctgttgcaaggcgggctgcgggtcaaatgtcacgcccgatttaaaatccatctctacctgcggccagttcttatggaaattttctaacgcgggtgtcagccactgaatacagctatggcactcaatggcaatgcgcagacgcgtctgctgcggttcattgcaggcttgcagggcctggctaatttgcggcagtacctggtttgccagttgcaacaggatttctccctgcggtgtaaagcgtagcggctggctcttacgcacaaatagccggaagccaaggcgttgttccagatcgctaaactggtgagacagggcggattgcgtctgatgcaacgtcgccgcagcggctgcgagcgagccgcagttccgcaacgcttgtagcgttttcaggtgttttacttcgatcatgaaagtccttcacttcggcatgaataatttgcgcttgaggaatatacagtaaccgccaattatggatgtgtaaacatctggacggctaaaatccttcgtcttttaaatttatggtgcgttggctgcgtttctccaccccggtcacttacttcagtaagctcccggggatgaataaacttgccgccttccctaaattcaaaatccataggatttacatataattagaggaagaaaaaatgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccacccggtcttttctcattacagcgacttcttcccaccatactgcttaaaccattccagcatacgctgccagccatcttctgcagatgcggcatgatagctcgggcgataatcagcgttgaatgcatgcccggcgtccgggtacacgataatctctgctttcgcattagcagcccgcagcgcctggcgcatggtttcaacgctctcctgcggaatgctgttatcctgaccaccatataagccgagaatcggcgcgttaagatcggttgcgatatcaacaggttgtttcggtgaattcagcgacttgtcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggggtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagggtgatttatgtgatttgcatcacttttggtgggtaaatttatgcaacgcatttgcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcactacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgtccgtctggatggcgcgagcctgcacttcgcaccgctggaattcccggctgtcgctgatttcgaatgtacgactgcgctggttgaagctgcgaaatccattggcgcgacaactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggtgttatcgttaaccgcacccagcaagagatcccgaatgctgagacgatgaaacaaaccgaaagccatgcggtgaaaatcgtggtggaagcggcgcgtcgtctgctgtaattctcttctcctgtctgaaggccgacgcgttcggccttttgtatttttgcgtagcgcctcgcaggaaatgcctttccaactggacgtttgtacagcacaattctattttgtgcgggtaagttgttgcgtcaggaggcgttgtggatttctcaatcatggtttacgcagttattgcgttggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgtgcagagtgcgagttactcaataacgaagtgcgcagcctgcaaagtattaacacctctctggaggccgatctgcgtgaagtaaccacgcggatggaagccgcacagcaacatgctgacgataaaattcgccagatgattaacagcgagcagcgcctcagtgagcagtttgaaaacctcgccaaccgtatttttgagcacagcaatcgccgggttgatgagcaaaaccgtcagagtctgaacagcctgttgtcgccgctacgtgaacaactggacggtttccgccgtcaggttcaggacagcttcggtaaagaagcacaagaacgccataccctgacccacgaaattcgcaatctccagcaactcaacgcgcaaatggcccaggaagcgatcaacctgacgcgcgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcgcctgccgcagggaaaagatgtggtgatcgacgccaaaatgacgctggtcgcctatgaacgctattttaacgccgaagacgactacacccgcgaaagcgcgctacaggaacatatcgcgtcggtgcgtaaccatatccgtttgctgggacgcaaagattatcaacagctgccggggctgcgaactctggattacgtgctgatgtttattcccgttgaacccgcttttttactggcgcttgaccgccagccggagctgatcaccgaagcgttgaaaaacaacatcatgctggttagcccgactacgctgctggtggcgctgcgcactatcgccaacctgtggcgttatgagcatcaaagccgcaacgcccagcaaatcgccgatcgtgccagcaagctgtacgacaagatgcgtttgttcatcgatgacatgtccgcgattggtcaaagtctcgacaaagcgcaggataattatcggcaggcaatgaaaaaactctcttcagggcgcggaaatgtgctggcgcaggcagaagcgtttcgcggtttaggagtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggagtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcatttggtattcatcgtttgtggaagcgattcacgattgattgcagcggcgtacgccgtgggcagaccgtgctggatctggctggtggcaccggcgacctgacagcgaaattctcccgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtgcttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaagccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgctgggtaaagtattgcgcgtggaggtaaaaggcttttcgacgtcattgattctggtgttcagcgaacgccaggttgatgtactgggcgaatgggcaggcgatgctgactgcaccgttatcgcctacgccagtgtgttgccgaaacttcgcgatcgccagcagcttaccgcactgattcgcagtggtgagctggaagtgcagggcgatattcaggtggtgcaaaacttcgttgcgctggcagatctggcagagttcgaccctgcggaactgctggccccttataccggtgatatcgccgctgaaggaatcagcaaagccatgcgcggaggcgcaaagttcctgcatcacggcattaagcgccagcaacgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagtcaggatgctgattttactgcgaaaactatcgccgataagcaggcggatacgaatcaggaacaggctaaaacagaagacgcgaagcgccacgataaagagcaggtgtaatccgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaactacgccaggccgcggagtcgatgaagcgttcctacgttgcaaacgatcctgaaaaggcgagcgatgaagcgcacaccatccataacccggtggtgaaagataatgaagctgcgcatgagggcgtaacgcctgccgctgcacaaacgcaggccagttcgccggaacagaagccagaaaccacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatcgcggtgatcgtgatattcctgtgtctggtctatttcgccaatgacatctatcacctggtatccgcgccattgatcaagcagttgccgcaaggttcaacgatgatcgccaccgacgtggcctcgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttcgttatggcgctgtttatggcgtttggtgtctcctttgaagtgccggtagcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatcccgatgtactgtctgtttgaaatcggtgtcttcttctcacgcttttacgttggtaaagggcgaaatcgggaagaggaaaacgacgctgaagcagaaagcgaaaaaactgaagaataaattcaaccgcccgtcagggcggttgtcatatggagtacaggatgtttgatatcggcgttaatttgaccagttcgcaatttgcgaaagaccgtgatgatgttgtagcgtgcgcttttgacgcgggagttaatgggctactcatcaccggcactaacctgcgtgaaagccagcaggcgcaaaagctggcgcgtcagtattcgtcctgttggtcaacggcgggcgtacatcctcacgacagcagccagtggcaagctgcgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagatttaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgcatggaatttatatcggcattaccggttgggtttgcgatgaacgacgcggactggagctgcgggaacttttgccgttgattccggcggaaaaattactgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgctaatgtcaaaacactgtttgggattgcgttttagagtttgcggaactcggtattcttcacactgtgcttaatctctttattaataagattaagcaatagcatggagcgagcctcaccatcgggttcggtgaaaatggcctgaaagccttcgaacgcgccttcggtaataatcaccttatcacccggataaggggttgccggatcgacaatgtctttcggtttatataccgatagctgatgaataaccgccgatgggactatcgctggcgacgcgccaaagcgcacgaagtggctgacaccgcgggtcgcgttgatagtcgtggtatgaatcacttctgggtcaaattccacaaacaggtagttggggaacaatggctcactgactgcagtacgttttccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgcagattaagaggctacaatggacgccatgaaatataacgatttacgcgacttcttgacgctgcttgaacagcagggtgagctaaaacgtatcacgctcccggtggatccgcatctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcggctgcgtggtgcgccctgccaacaaaaaatcgtctctggcgatgacgtcgatctcaatcgcattcccattatgacctgctggccggaagatgccgcgccgctgattacctgggggctgacagtgacgcgcggcccacataaagagcggcagaatctgggcatttatcgccagcagctgattggtaaaaacaaactgattatgcgctggctgtcgcatcgcggcggcgcgctggattatcaggagtggtgtgcggcgcatccgggcgaacgtttcccggtttctgtggcgctgggtgccgatcccgccacgattctcggtgcagtcactcccgttccggatacgctttcagagtatgcgtttgccggattgctacgtggcaccaagaccgaagtggtgaagtgtatctccaatgatcttgaagtgcccgccagtgcggagattgtgctggaagggtatatcgaacaaggcgaaactgcgccggaagggccgtatggcgaccacaccggttactataatgaagtcgatagtttcccggtatttaccgtgacgcatattacccagcgtgaagatgcgatttaccattccacctataccgggcgtccgccagatgagcccgcggtgctgggtgtcgcactgaacgaagtgtttgtgccgattctgcaaaaacagttcccggaaattgtcgatttttacctgccgccggaaggctgctcttatcgcctggcggtagtgacaatcaaaaaacagtacgccggacacgcgaagcgcgtcatgatgggcgtctggtcgttcttacgccagtttatgtacactaaatttgtgatcgtttgcgatgatgacgttaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatctgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccggatgaaaaagggtttatcgagctgcatattggcgcttctgaaatcaacctttacgcgaaagcagtcatggaccgcatcctcaaagatcatcaaatcgtggtcgacattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctgcaagtggtgccggtggttgaacaaccggaagcgggctggcgtgggcgtactggcaccgtgttaacggcggtattgcaggatcacggtacgctggcagagcatgatatctatattgccggacgttttgagatggcgaaaattgcccgcgatctgttttgcagtgagcgtaatgcgcgggaagatcgcctgtttggcgatgcgtttgcatttatctgagatataaaaaaacccgcccctgacaggcgggaagaacggcaactaaactgttattcagtggcatttagatctatgacgtatctggcaaaccatgcccgatgcgacgctgtcgcgtcttatcgtgcctacaaatagtccgaaccgtaggccggataaggcgtttacgccgcatccggcaattggtgcatgatgcctgatgcgacgctgtcgcgtcttatcgtgcctacaaatagtccgaaccgtaggccggataaggcgtttacgccgcatccggcaattggtgcatgatgcctgatgcgacgctggcgcgtcttatcaggcctacattggtgccggatcggtagaccggataaggcgttcacgccgcatccggcaagtggttaaacccgctcaaacaccgtcgcaataccctgacccagaccgatacacatcgtcgccagaccaaactgaacgtctttgcgttccatcagattcagcagcgtggtgctgatacgcgcaccggaacaacccagcggatgacccagcgcgatcgcgccaccgttgaggttgatcttctcgtcaatctgctcaattagtcccagatctttaatacatggcaggatctgcgcggcaaaggcttcgttcatttcaaacacgccgatatcgctggcagaaagccccgcttttttcagcgccagtttcgaggccggaaccgggccgtaacccataatcgatgggtcacaaccaacgaccgccatcgaacgcacacgagcgcgcggcttaagacctaattcatgggcgcggctttcactcatcaccagcatggcagctgcgccatcggaaagtgcagaagatgtgcccgccgttaccataccgtttactggatcaaacgccggacgcagcgtggcgagggcttccacggtggtttccgggcgaatcacttcgtcgtaattaaactgcttcaggacgccgtcggcatcgtgaccaccggtcgggatgatttcatttttaaatgcggccgactgcgtggcggcccaggcgcgggcgtgtgaccgcgcggcaaaggcatcctgcatttcacggctgataccgtgcatacgcgccagcatttctgccgttaagcccatcatgcccgccgctttggcgacattgcggctcaggccggggtgaaaatcgacgccgtgactcatcggcacatggcccatatgctccacgccgccaaccagacatgcctgcgcatcgccagtcatgatcattcgtgctgcgtcatgcagtgcctgcatggatgaaccacacaagcgattaacggtaaccgccgggacagagtgtggtacttctgccagcagcgccgcgttacgggcgatattaaaaccctgctccagcgtctgctgcacacaaccccagtaaatatcgtcgagggccgccgcttccagcgccgggttacgcgccagcaggctacgcattaaatgagcggagagatcttctgcacgcacgttacgaaaagcaccgcccttcgaacggcccatcggggtgcgaattgcatcgacaatgacaacctgttccattgtgactccttaagccgttttcaggtcgccaaccggacgggctggctcaaccggaggatagtacggttcgttatgacgcgctttattacgcagaccttccggcacttcatacagcgggccgaggtgctgatattgctgtgccatatcgaggtattttgcgctaccgagggtgtccagccagcggaacgcgccgccgtggaacggagggaagcccaggccgtagaccagcgccatatccgcttccgccggagtggcgataatgccttcctccagacagcgcaccacttcgttgaccatcgggatcatcatgcgggcgataatctcttcttcgctgaaatcgcgcttcggctggctcacttctgccagcaggtcttcaacggcggcgtcttcttctttcttcggcttacctttgctgtcttctttataacgccagaaaccgaggccgttcttctgaccaaagcggttggcatcaaacagcgcgtcgatggcatcgcggtaatctttctgcatccgctgcgggaagcctgctgccatgacagcctgagcgtgatgcgcggtatcaatgcccacaacgtccagcagatatgccgggcccatcggccagccaaactgtttttccatcactttgtcgatcttgcggaaatccgcgccgtcgcgcagcagctggctgaaaccggcgaaatacgggaacagcacgcggttaacaaagaagccggggcagtcgttaaccacaatcggcgtcttgcccatcttgctcgcccaggcgacaactttcgcgatggtttcgtcggagcttttctcgccgcgaataatttctaccaacggcattcggtggaccgggttaaagaagtgcatcccgcagaagttttccgggcgttccagcgcgttggccagttcgctgataggaatggttgaagtgttagacgccagcacggtatcctggcgtactttttgttcggtttctgccagtacggcttttttcactttcgggttttcaacaaccgcttctaccacaatatccacgcggtcaaatccggcgtagtcgagcgttgggtggattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaagcgatgccgccgcccataatgcctgcacccagcaccgcggcctgtttcggggtttcaacgtctttggtgagtttcttcgctttgccttttacatattgatcgttaaggaaaatgccgaccagtgcgcgggcttcgttggtatgcgccagcgggacaaaacttttgttttccaggtttaaggcttcttcacgaccaaaacgggccgcagcttcaatggtttttactgcggtgatgggggccggataatgtttccccgctgtttgtgcgaccatccctttagcgatggtgaagctcatggtggcttcaatcttgctcagttttagtggttccagcttcggctgacgttttgctttccagtcgaggtcgccgttaatggcctggcgtaaaaccgcctttgcgccttcaaccagtttttctgctttgactacgccatccaccagaccgattttcagcgcctgatccgcgccgacatctttaccggcggcaatgatttccagcgcactgtcagcgcccagcatacgtggcatacgtacagaaccgccaaagccaggcatgatgcccagtttggtttccggcagaccgatgcgcagatccggcgtcgccagacgataatcggtcgccagcacgcattcgcagccaccgcccagcgcatagccattgacggcagcaatggtcggcaccggcagatcttccaggcgattaaacacgctattggcaaagtgcagccactgacttaactgttcttcaggaacgaggaacagggacaaaaattcggtgatatcagcaccgacgataaaggctgctttgttcgaacgcagcagcagcccttttagatctgattgctgttccagcacgccgatggcctcgccgaggctggcgacggtcgcagtgtcgagtttattaactgaacctggggcatcaaataccagttcggcaatgccatcttccagccagtcaaggtacagggtgtcgcctttgtaaagcatgtcagtctcctgaatccgcaaggtgatctggtcgtaccagatgagtcgaagtgtgtattttgtgttaaaaatatgcaaacaaaagattaaagaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaagaacggactcgcgatgcgctggcgcgcttcaagctggatgcgttacttattcactccggcgagctgttcaatgtttttctcgacgatcatccctatccgtttaaagtgaacccgcaattcaaagcgtgggtgccggtaactcaggtgccaaactgctggttgctggtggatggcgtgaacaagccgaaactgtggttctatctgccggttgattactggcacaacgtcgaaccgctgccgacctctttctggactgaagatgtggaagtgatcgcgctgccgaaagccgatggcattggtagcctgctgcctgctgcgcgcggcaatatcggttatatcggtccggtgccggaacgtgcgctgcaactgggtattgaggccagcaacatcaacccgaaaggggttatcgactacctgcattactatcgctccttcaaaactgagtacgaactggcctgtatgcgtgaagcgcagaaaatggcggtcaacggtcaccgcgcggcagaagaagcgttccgttctggcatgagcgagttcgatatcaacattgcctatctgaccgcgaccggtcatcgtgataccgacgtaccttacagcaacattgtggcgcttaacgaacacgctgcggtactgcattacaccaaactggaccatcaggcaccggaagagatgcgcagcttcctgctggatgccggggcagaatataacggctatgcggctgacctgacccgtacctggtcggcaaaaagtgacaacgactacgcgcagctggtgaaggacgttaatgatgaacaactggcgctgatcgccaccatgaaagcaggcgtcagctatgtggattaccacatccagttccatcagcgcatcgccaaactgctgcgtaaacatcaaatcatcaccgatatgagtgaagaagcgatggtcgaaaacgatcttaccgggccgtttatgccgcatggtatcggccatccgctgggcctgcaggtgcatgacgtcgctggttttatgcaggatgatagcggtacgcacctcgcggcaccggcaaaatatccgtacctgcgctgcacccgtattctccagccgggcatggtgttaaccatcgaaccgggtatctacttcatcgaatcgctactggcaccgtggcgtgaagggcagttcagcaagcacttcaactggcagaaaattgaagcactgaaaccgttcggcggcattcgtatcgaagacaacgtggtgatccacgaaaacaacgtggaaaacatgacccgggatctgaaactggcgtgatggaaagctggttaattcctgcggcaccggtcacggtcgttgaagagatcaaaaagagccgcttcataacgatgttggcgcataccgatggcgttgaggcggcgaaagcgtttgttgaatcggtgcgggcagaacaccccgatgcccggcaccattgcgtggcgtgggtcgcgggtgcgccggatgattctcaacagctgggtttctctgacgacggggagccggcgggaacggcaggtaaaccgatgctcgcccagctaatgggcagcggcgtcggggaaattaccgctgtggtagtgcgctactacggcggcatattgcttggcaccggtgggttagtgaaagcgtatggcggcggcgtgaatcaggcgctgcgccagctaacgacccaacgcaagacgccattaaccgaatatactttgcaatgtgaatatcatcagttaaccggcattgaagcgttgctggggcagtgtgacggcaaaattatcaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctgtggtggccgaaccgcaaagagaaaggcgaacttaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccactacgggagccactacgctggtggggctggattcgctccctcacgccatcctcttttatcgccagatgctgcaatggtttggcgggatggggatcatcgtgttggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgccggaatggatgcctttgatgccatcggccatagctttgcgactatcgctattggcggcttctcgacacatgatgccagtatcggttatttcgatagcccgactattaacactatcattgctatcttcctgctgatctccggctgtaactacggtctgcacttttcactgttaagtgggcgtagtctgaaggtttattggcgcgatccggaatttcgcatgtttatcggcgtacagtttacgctggtggttatttgtaccctcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcctttatcggcggttgcgccgggtcaacgggcggtggcctgaaggtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcgtcggttgttgcgacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcataaagaataaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagaggggtaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgtgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagccgcaaggcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctcctcatgcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcattggcgcagaaaaaaatgccggatgcgacgctggcgcgtcttatccagcctactcttgcttatccgttctgcttttgcatccactccaccacaaaatcagccagcccctcaacatcattaatatccagtaatgcgacatcaagattaagcggcacatcactggctacagcaataacatgcctgtctatcactaattcttcaggtcgatgtccggctccatcgcgaaacagcacaatctttgcgatctcttcatgcttaaacccttcgaccagaatcaaatccagctttgaggtatccattcgacttgcgagaaactgtagatccagctcttcttcgtctggtgtttccgtcatcaaggcccatcgttgctggctggcaacgatggtttgtgccgcgccagccttgcgcagctcatagctatctttgcctggcttatcaacatccatatcatggtgcgtatgcttaatcagccctggacggatccctctggcgcataatgccgggatcagttttttcaaaagcgtagtttttccggtaccactccacgcggcaaaggcgagtaacggtatcatcgtttttcctgccatcgggcaagctcctctggcgtattcacgttaacaaatgcatctttatgatcgctgaaatcaaccgcatgaccgccagccagacgcataaataccattacccggcgttctcctgcttgcagatattccagtaataaaggctcaatagcgcggtttaccagagcaatagtcgggtgatcgcgttcaccgtcatggacccacacgacaggcgcatctttgcgctgatgattaagcctggctgctaaatcagggggaatgtaaggcgtatcgcacgggcaaaacaaaaaccactcaccagcttcctgctgcattactgaaagcattcctgccagagggcctgggtaatccgccagtgaatcttcaatcactttcagaccgcttgcctgatagatttcctgatgacgattagcattaaccacgacgtgagagagctgcgtcataagcgcgtcagcgacatgttgccataatggtttgccgtttaattcaagcaatcctttatctacgccgcccattcgtctggctttaccgcctgccagcacaacgcctgttatcgtcgtcatcagattcaccgatatcgcctcttttattgtgggattgaccctgctaacgtgtctgtctcaagagtaaggagcatcactatgaaatgtaaacgtctgaatgaagttattgaactcctccagccagcctggcaaaaagagccagaccttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagacttcaaaacggcgctgttacgcgctcgcggcgtaattaaagagtaaaagcttgtaagcggcgccaccaaaatcatcgtgaaatgatatccttcgtcattcgtaatgttttccggatgatgggatgaataacagcgcttttactttccagacactacacccggataccatcatggacgctctgtttgagcatgggatccgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggtaaatgatgaagttccggtcgcagcacctgtggcctttaacggtcagactttattgaatcatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaacgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggcgataaagccgagcagcggatgcaactggaaactattattgaagcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctgcgacagacggcgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccggtagctggcgcgccgcaagtgctggagtttttctctttcttctgcccgcactgctatcagtttgaagaagttctgcatatttctgataatgtgaagaaaaaactgccggaaggcgtgaagatgactaaataccacgtcaacttcatgggtggtgacctgggcaaagatctgactcaggcatgggctgtggcgatggcgctgggcgtggaagacaaagtgactgttccgctgtttgaaggcgtacagaaaacccagaccattcgttctgcttctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggcgttccggcgatgtttgttaacggtaaatatcagctgaatccgcagggtatggataccagcaatatggatgtttttgttcagcagtatgctgatacagtgaaatatctgtccgagaaaaaataattcaatgtaaattacataaagcccgtgaatattcacgggctttttttattatttaataaatataaatacattctgataatgcatcctgccgctggacattatttcagcataagtggatattcaaagttttgctgttttatcagggaatatttatatgatacgtaagtcagctacaggtgttattgttgcgttagccgtaatctggggtggtggcacatggtacacaggtacgcaaattcagcctggtgtcgaaaaatttattaaagattttaacgatgctaaaaagaaaggtgaacatgcctacgatatgacgttaagttatcaaaattttgacaaaggcttttttaattcccgttttcaaatgcaaatgacattcgataacggtgcacccgatctcaatatcaagccaggccagaaagttgtatttgatgtggatgttgagcacggtccgttgcccatcacaatgttaatgcatggtaatgtcatcccagcactggcagcggcaaaagtgaacttagtgaataatgaactgacacaaccgctatttatcgccgcgaaaaataaatcgcccgtggaagcgacattgcgattcgcgtttggtggctcattctctacgacattagatgttgcccctgcagagtatggaaagttttcttttggtgagggccagtttacttttaatggtgatggtagttcattgtctaacctggatattgaaggcaaagtcgaagatattgttctgcaattatcaccaatgaacaaagtaacggcaaaaagttttaccattgattctctggcgcgattagaagaaaagaaatttccggttggtgaaagcgagtcgaaatttaatcagattaacattatcaatcacggggaagacgttgcccaaatcgatgctttcgttgcaaaaaccaggctggatcgcgttaaagacaaagattatatcaatgtcaatctcacctacgaacttgataagttaacaaaagggaatcagcaactcggtagtggtgagtggtcattgattgctgaatctattgatccctcagcagtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgaccattaaacaaccggtaagatggaagaacgcactcggcgaactaaatgccaatctggatatcagtattgccgacccagccaaatcttcatcatccacaaacaaagatatcaaatcgctcaattttgatgtgaagttaccgcttaatgtcgtcacagaaaccgcaaaacagcttaatttatctgaaggaatggatgcggaaaaagcgcaaaagcaggctgataaacaaatcagcgggatgatgacattaggtcagatgtttcagttaatcacgattgacaacaataccgcctcgctgcagctgcgttatacaccgggtaaagttgtttttaacggacaggagatgagcgaagaagaatttatgtctcgtgccggacgttttgttcattaaaatactcactcgcctctgctcattcagaggcgagtaaaacttacttattctgacgctgtgatgacatgagagacgtcagaagccggtctttttcctgccacaatgagttcagccattgctgaaaatggcgcttaaagcttttgtcattgatgtagtcgccatgtaactcatcggcaataggctgtaaatccacatgtacgacaatccgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagtggagtgggtttgctgatgtttttcttgcgtgaaacgggagccttcaacgaaattgacaatggtggtgggatgcaggcgaaacttttcacaagaacgccgagtggtttcaacatctttaccacgtcgctccggatgacgtaataaataagcgcgggaataacgcttcataaacggcatatccagcgaccagcacgccaggccaagaaatggcacccaggccagctgttgcttgaggaaatatttattcatcggaatgtgcttacgaaacagcacgcacagtacgacaatatctgcccaactacggtggttacaaataagcagataccagttcttcttacttaacccttccagcccgtgaacttcccattgaaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggaacaaaaaatagtgaccaaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccattatctcaattattagggatggatttatttttaactgcatgaaaaacaaagacaaacatcatgctgtaaaaagcatgataataaattaaaagcgatgtaaataatttatgcacaaagttatccacatgacgatttgcgagcgatccagaagatctacaaaagattttcacgaaaagcggtgaaaaactcatgttttcatcctgtctgtggcatcctttacccataatctgataaacaggcacggacattatggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgtgcacaaatcgaacccttgcacgcgatggttaaagcgatgggactgccgctgctggcggtttctggcgtagaagcggacgacgttatcggtactctggcgcgcgaagccgaaaaagccgggcgtccggtgctgatcagcactggcgataaagatatggcgcagctggtgacgccaaatattacgcttatcaataccatgacgaataccatcctcggaccggaagaggtggtgaataagtacggcgtgccgccagaactgatcatcgatttcctggcgctgatgggtgactcctctgataacattcctggcgtaccgggcgtcggtgaaaaaaccgcgcaggcattgctgcaaggtcttggcggactggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagcaaccggcagcggaagagttgttggggctgttcaaaaagtatgagttcaaacgctggactgctgatgtcgaagcgggcaaatggttacaggccaaaggggcaaaaccagccgcgaagccacaggaaaccagtgttgcagacgaagcaccagaagtgacggcaacggtgatttcttatgacaactacgtcaccatccttgatgaagaaacactgaaagcgtggattgcgaagctggaaaaagcgccggtatttgcatttgataccgaaaccgacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactgcgtgggattgcgtttgataccatgctggagtcctacattctcaatagcgttgccgggcgtcacgatatggacagcctcgcggaacgttggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgctgatgatcaacccgaaaaccgggcgtgtgcatacctcttatcaccaggcagtaactgcaacgggacgtttatcgtcaaccgatcctaacctgcaaaacattccggtgcgtaacgaagaaggtcgtcgtatccgccaggcgtttattgcgccagaggattatgtgattgtctcagcggactactcgcagattgaactgcgcattatggcgcatctttcgcgtgacaaaggcttgctgaccgcattcgcggaaggaaaagatatccaccgggcaacggcggcagaagtgtttggtttgccactggaaaccgtcaccagcgagcaacgccgtagcgcgaaagcgatcaactttggtctgatttatggcatgagtgctttcggtctggcgcggcaattgaacattccacgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggttacaggctgagcaaccgcgtgtacgtatgatcatgcaggtacacgatgaactggtatttgaagttcataaagatgatgttgatgccgtcgcgaagcagattcatcaactgatggaaaactgtacccgtctggatgtgccgttgctggtggaagtggggagtggcgaaaactgggatcaggcgcactaagattcgcctgaacatgccttttttcgtaagtaagcaacataagctgtcacgttttgtgatggctattagaaattcctatgcaacaactgaaaaaaaattacaaaaagtgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatgcgctatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcaacgaagaaaacgtttcaacctgcacatcaccgttaaacgccagtacagcttcacgcaccatattcaattgcgctttacgtgcgccgcttgccagtttgtccgctttggtcagcagcaccagaacggcgatattgctgtctaccgcccactcaatcatctgctgatccaaatctttcagcggatggcgaatatccattagcaccaccagaccttgcaggctctgacgtttttcgaggtattcgccgagcgcacgctgccatttgcgcttcatctcttccgggacttccgcataaccgtacccaggcaagtcaaccagacgcttgccgtcagccacttcaaacaggttgataagctgggtgcgccctggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccgtcagtcaaagctttgtggcgattatacctgaaccataataaaaggcggatttttcggcgtgagcgttgtaagtaaaagccatacgctttgtgagacattgccgatagtctttatgcgaaatagcagagaaaattctgcgatgcatgtcaaataagctatataaatcagtgaattgcttttatataaaactctgaaaatgtgcaaatactgatggcggttgattgtttgtttaaagcaaaggcgtaaagtagcacccatagagcgaggacgctaacaggaacaatgactcaggatgagggtcaggagcgccaggaggcgaagacagaggattgtcaggaagacaaacgtccggagacgtaattaaacggaaatggaatcaacacggattgttccggctaaaggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgatcgcaagcgtcagaaaaaacgtcgtggtcatgcgccgggcagccgcgcagcgggcggaaacaccacgtcaggcagcaaaggccagaacgcaccaaaagatccacgtattggcagtaaaacccctattccattgggcgtgactgaaaaagtcaccaaacagcacaaaccgaagagtgagaaacctatgctttcaccgcaggcggagttggaattactggaaacggatgagcgtctggatgcgctgctggaacgtctggaagcaggcgaaaccctgagtgccgaagagcaatcctgggtggatgctaaactggatcgtattgatgagttgatgcagaaactcggcctctcttatgacgatgacgaagaagaggaagaagacgagaagcaagaagacatgatgcgtctgctgcggggcaactaacggattgccgccgtgggccttcccgttctgctgataacccttccggttatatgttatctggtgtggttattcgttaaactacagcggttgtcgcggcgacaaaagtggctgcgcaaccggctgatgacccgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatatcccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgcctgatgaagctgctgcgcgaaaacttccagttcaatgccgatgcggagatttcgatcgaagtcgatccgcgggaaatcgaactggatgtactcgatcatttacgcgccgaaggctttaatcgcctgagcatgggcgtgcaggacttcaacaaagaagtgcaacgtctggttaaccgcgagcaggatgaagagttcatctttgcactgcttaaccatgcgcgtgagattggttttacctccaccaacatcgacctgatttacggcctgccgaaacagacgccggagagtttcgcctttaccctgaaacgtgtggcggagctgaaccccgatcgtctgagtgtctttaactacgcgcatctgccgaccatttttgctgctcagcgcaaaatcaaagatgctgacctgccgagtccgcagcaaaaactcgatatcctgcaggaaaccatcgccttcctgacgcaatcgggctatcagtttatcggtatggatcactttgcccgtccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagaaacagtgggatttgcacttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaaatagtgaatggcgcttcgtttacaaagtagaaaacgaaagcgccatcaatgtgctgagaacaagattgcctgatgcgctgggcaacaaaacctgttgaaattattgcttttgtaggccggataaggcgtttacgccgcatcaggcatctgagcatgatgcctgatgcggcgctggtcgcgtcttatcaggcctacgactttctccgcatccggcataaacaacgagcttcagctaaacagcccaatcattgcggcacacagcacggcagcaacggcagtttgcggtgtgtggctgtcaactgcgccactcgataccagattaattattgattccagcataatgactctccccgttttccgggcaagatcatactgaacttatcggaacagtaaagcgtaaaataccagcaatttgcgctcaataatcaatctttacacacaagctgtgaatcactccatccccagctcttttaacttacgcgtcagggtgttgcggccccagccgagtagccgcgccgcttcctgtttatgcccctgcgtatgtcgcaacgcggtcgtcagtaacgtccgctccagctctggctgcgcttcggaaagcagattttgatgaccggaacgcagcgctctgtctgcccactgcgcaagaagcgtcgcccagctgtccggttgcatttgcgaagtactctccgcaaccgttgattcaaacagttcgccgggcaaatcctgaatcaacacttcctgcccggcggccatcaccgttagccagcggcaggtgttttccagctggcgcacgttgcctggccacgccagacgcgtcagagcagcttcggtttccggatgcagtaacttcgcttctacgcccagttcgcgcgcggcaacctgtaaaaaatggcgcgccagacggggaatatcttcccgacgttcgcgcagcggcggcagatgaacgcggataacgttcaggcggtggaacagatcctcacggaacttaccttcctgcactcgctgttcgagattctggtgagtggcagcgataatccgcacatccactttcaccggcgcatagccgccaacgcggtaaaactgaccgtctgccagcacgcgcagcaaacgcgtctgcacatccagcggcatatcaccaatttcgtcgaggaataatgtaccgccatcggcctgttcaaaacgcccctgacgaatggtattcgcgccagtaaacgcgcctttctcgtggccaaacagttctgattcgatcaaatcttttgggatagctgccatattcagcgcgataaacggcgctttggcgcgcggactgtggcgatgcagggcatgagcgaccagttctttaccggtgccggattcgccgttaatcagcacgctaatagaagaacgcgaaagccgaccgataatacggaacacgtcctgcatggctggcgcttcgccgatgatatcggtcgttgggccgttaagctgaacattacgcggctgctgctgttcctggtaatgactgatagcgcgctcaaccagcgccactgcttcgtcgatatcaaacggtttgggcagataatcaaacgccccttgttgataggcgctgacggcagcatccagatcggaatgtgcggtcataatgatgaccggaagcattggatggcgctgtttaatctgcttgagcagcgccagcccgtccattcccggcatacggatatctgaaagcagcacatccggcgttttgctcgccagcgcctccagcacttctgcgccgttctcaaacgtcgtacaggttaaacctgccccagcgagcgcacgttcaagcacccaacggatggaactatcgtcatcgactacccagactatccctcgttgcataaacgtcacctttatttcctgataggcaggtaaaccgagaactcggtatgccctggccaactggtaaattcaattttgcctgaatgctgatcaatcaaattacgagcgatggataagccaagcccggtgccaccttcgcggccgctgaccatcgggtaaaacagcgtatcctgcaaatgaggcggaatgcccggcccgttatcttccacatcaatccgcgccgccagccggtagcgctcgccgtgtaaggtcagttgaaacgcggtgcgggtacgcagaatgatttcaccgccttccggccccagcgcctgtagcgcattgcgcacaatattcagcaagacctgttcaatttgatccgggtcgtgcgccagttccggtaggctgggatcgtaatcacgaatcaaccgcacgttgtccggcagttccatcgacaccagcgttaccacgcgttcagccactttgtgaatactttcggtaacgcgcgtaccgggcagctgcggccccaacagacggtcgaccagatttcgcagccggtccgcctgttcgataatcactttggtatattcgagtagtgatgggtcaggtaacgctttgctgagcagctgcgccgcgccacgtaaaccgccaagcggatttttaatctcatgtgccaggccgcgcactaaatcacgggcagcaacctgctgggcgtgctgtagctgttcctgacttaagcggcgctggttatccatcggagccatctccagcaggatcatgccgtccggcatacgctgggccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggtgtaccaaacaatttgcgggagctttgggcgagcagttgttgcgcggcagggttggcgtaatggatcgccaggttgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctacagatagctgacaaacttcacgttggagagcgactcacctgctccggcctaccacatcatcaccgtgtaggccggataagacgcatttgcgtcgcatccggcgtgatgtgcttgccaccgatcccaggcctgccagagacaggcgaaaagtttccacggcaactaaaacacttagacgctgtagtacagctcaaactctaccggatgcggagtcatacgcacgcggtcatcttcttcgcgacgcagagcgatgtacgcatcaattgcttcgtcagtgaacacgccaccggctttcaggaactcgcggtccagatccagttcgttcagtgcttcttccagagagcctgcaacctgtgggatctctttcgcttcttctggcggcaggtcatacaggtttttgtccatggcttcgcccggatggatcttgttcttgataccatcaagaccggccatcagcagggcagcaaagcacaggtacgggttagctgccggatccgggaaacgtacttcgatacgacgtgctttcggagaagaaaccaccggaatacggatagacgcagaacggttacgcgcagagtaagccagcattaccggtgcttcatagcccgggaccagacgcttataagagttggtggtcgggtttgccagggcgttaatcgctttagcgtgtttgattacgccgccaatgtagtacagcgcctgctcagacagacctgcgtatttgtcgcctgcgaacaggttaacgccgtttttagacagagacatgtggcagtgcataccggagccgttatcaccgaacatcggttttggcataaaggtcgcggttttaccgaagcggtgcgctacgttgtgcacaacatatttgtagatctgaatttcgtcagcttttttggtcatggtattgaagcgggtagccacttcgttctgaccagcagtcgctacttcgtggtgatgggcttcaaccaccagacccatctgttccatcaccagacacatttcagaacgaatatcctgagccgagtctaccggtggaaccgggaagtaaccgcctttcactgccggacggtgacctttgttaccaccttcgtattgggtggaggagttccatgcgccttcgatatcgtcgatagcaacgtgggaaccggagatagatgatccgaaacggatgtcatcgaacaggaagaattcaggttctggcccgaacagtacggtgtcggcaatgccagtggaacgcaggtaatcttcggcgcgcttcgcaatggagcgcgggtcacggtcatagccttgcagggtgccaggttcaaggatgtcgcaacggataatcagggtggagtcggcgaagaacgggtcaatcactgcggtggatgcgtctggcatcagcaccatgtcggactcgttaatgcctttccagccgccaatcgaggagccgtcaaacattttgccttcttcgaagaattcagcattcacctgatgagcagggatagtgacgtgctgttctttacctttagtatcggtgaagcgcaaatcaacaaacttcacttcgtgctcgttcagcatcgtcagtacgtgttcagcggacatactttaactctcctggattggtcatggtcgtcgtggtaacgaaatctgcaattattttggccgtgtcgccgtaaaaaagataaagcgaaatctgtgccaacttttaaattgcccctaaaaggcgttatcatgcgcaccatcgtgcaaaagggctgcaccacgatgtgaatgttgcaccaatatagtgcttcaatggaaacattaagcaccatgttggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctatccgtattcgtaaacgtcacctgacggaaaacgatcgtcgccgcgccaaccgcgcaccgaaagacgattaatttcgttttttagtcataaaaaacctgccagcgatggcaggtttttttttgcctgtcgtgagcgcacaccaatgcgagtatctcccttataagtctgtggttacgtcaatagagagctttgtcacaattatctgcaaagtcatacgccgttaattgctttcttttttggcgtaagcgtaagatgcttcatctggtttaaaccaaaaggattaaacaatggcggagaatcaatccaccgtagaaaatgcaaaagagaaactggatcggtggttgaaagatggcatcaccacgccgggtggaaaactcccttcagaaagagagctgggagaactgctgggcattaaacgtatgacgctgcgccaggcgttgttgaacctcgaggcagaatccaaaatcttccgtaaggatcgtaaggggtggttcgtgacccagccgcgatttaattacagtccggagctgtcggcgagctttcagcgggccgcaattgagcaagggcgagagccttcctgggggtttaccgagaaaaaccgtaccagcgatattcccgagacgctcgcgccactgattgcagtgacgccatcaactgaactctatcgcatcaccggctggggggcgctggaaggacataaagttttctatcacgaaacatatattaatcctgaagttgctccgggctttattgaacaacttgaaaaccactcattttctgcagtctgggaaaagtgctaccaaaaagagacggtagtaaaaaaattgattttcaaacccgtcagaatgccgggcgatatcagcaagtatcttggcggttctgcgggtatgccagcgatcttaattgaaaagcatcgcgccgaccagcaaggcaatattgtccaaatagatattgaatattggcgatttgaggccgtagacctcatcattaatctgtaggtgttttatggtgacaataaataacgcaagaaagattctacaacgtgtcgacactcttcctctttatttacatgcttatgcctttcatttaaatatgcggctggaaagagtgttgcctgctgatttacttgatatcgcaagtgaaaataatctacgtggcgtcaaaatccatgttctcgatggcgagcgtttttctcttggtaatatggacgataaagaactctctgcctttggggataaagcccgccgtctgaaccttgatattcatattgaaaccagcgcctcagataaggcatctattgacgaagccgtcgccatcgcgttgaaaactggggcatcgtccgtacgtttttatccacgttatgaaggtaatttgcgcgacgtattatcgattatcgctaacgacattgcctatgtacgggaaacgtatcaggacagcggcctgacttttacgatcgagcagcatgaagatttaaaaagtcatgagctggtgtcgctggtcaaagaaagtgagatggaatctctttccttactgtttgattttgcgaacatgatcaatgcaaatgagcatcccatcgacgctttaaaaacgatggcaccgcatattacccaggtccatatcaaagatgccttgatcgttaaagaaccgggtggcctgggtcataaagcctgtatttcaggtcagggtgatatgccgttcaaagcgttattaacgcaccttatctgcctgggtgatgatgagccgcaggtgacggcatatggcctggaagaagaggttgattactatgcgccggcgttccgctttgaagacgaagatgataatccgtggatcccttatcgccagatgagtgaaacaccattgccagaaaatcatttactggatgcgcggttacgtaaagaaaaagaagatgcaattaatcagataaatcatgtgcgtaacgtactacaacaaatcaaacaagaggcaaaccatcttctgaaccactaataagttttaactcatacgcagttaataaaaccattccatatgaatggtcggtatcttattgcctttaaaacagtgattttaaaaatcgcttaggggatgttatgctcacgaaaaagaaatgggcgttatttagtctattaacactgtgtggcggtacaatttataaattaccgtcgctgaaagatgcgttttatatcccgatgcaggaatatttccatttgaccaatggtcaaattggtaatgctatgtcggtaaactcatttgtcaccacagtgggcttttttctgtctatttattttgccgataaactaccgcgcagatacaccatgtcattctcactcattgcgacaggattactgggtgtttatttgacgacaatgccggggtattggggcatcctctttgtctgggcgctatttggcgttacttgcgacatgatgaactggccggtcttgctcaagtcggtaagtcgattgggcaatagcgaacaacaaggtcggttgtttggcttcttcgaaacagggcgtggcattgtcgataccgtggtggcattttctgcgttggcagtatttacctggtttggcagtggcttattaggttttaaagcaggcatctggttctattcccttattgtgattgccgtaggcattattattttctttgtcctgaatgacaaagaagaggcaccgtccgttgaggtgaaaaaagaagacggagcatcgaaaaacaccagtatgacctcggtgctgaaagacaaaactatctggcttatcgcttttaacgtcttcttcgtttacgcggtttactgtggcctgacattcttcattccattcctgaaaaacatctatctattgcccgttgcgctggtgggggcttacggcatcattaaccaatactgtctgaaaatgattggtggaccgattggtggcatgatttcagataagatcctgaaatcgccaagtaaatatctatgctacacctttatcattagtaccgctgcgctcgtactgttgattatgctgccgcacgaaagtatgccggtctatttagggatggcatgtacgctgggctttggcgcgatagtctttacacagcgagccgtattttttgcacctatcggcgaagcaaaaattgctgaaaataaaacaggtgcggcgatggcgttgggtagctttattggttacgctccggcgatgttctgcttcagtctgtatggctacattctggatttaaatccggggattattggctacaaaatcgtgtttggcattatggcctgcttcgcattcagtggtgcggtggtttccgtaatgctggttaagcgtattagccaacgtaagaaagagatgctggcggctgaagcttaattaatggccggatgtgcttaatccggccaacgaaaaccgtatcaaccgtaggccggataaggcgtttacgccgcatccggcagtttcacatcagaagaaatacttcgtcccgatacggatctggttttgctcgcggtggtacggttcgacgttgcggtctaaccagcgcaattcgaaataagggagccagtgttcattaatacggtaacggaaggtgttagtgatttcccaatgatgatctttcccgttgctactattaaagtcattcactcgcatgaagtaatgtggctcaaatgtataggaaaatttatcggtgattttaaaattccagtaggtgccaatttcataggtgtcattattatccagttccccgctcaaatctgttgaactatagttattatggttatagcgatttcgtactgtcagattaaaccatggtacaaatttatagttgacgtccagatacactgcaccacccgaaccgatactcttatcattaattaagccaccgggctggatggttaatttatcggttggtttaaataacggataccagccttcaatttcgttatatccatgttttagttcatcttctcgctgaaagttgtaggtattggttaacataatacccgcgcccatatcgaagttataacccacacgtagcataacctcgccctgatcggaggcaagattatatgcctccctgttttcgacgtatgcgccagcaaataccgaggcagaggtcagagaagataataaaattattgcattaatctttttcataataagtccattttttaaacgtagggaggccgccacccaccaggatggaaatagcggctattgacatttataacgttacggaagccgttttttcttctgtcgccatctctttatttttgcgttggttgatttcctcaataatcaatgcaaaccgtttttcattgagtgtgtaaaagaatcccatcgtcaatgcagcaataattgccagtgcacaaggccagataaaaatgagctgacgcaaaccctgtaatgtcgcatcgctttgcgcgatgttgggaacataaccaatttgcgtcagcataatgcctggcaagaagccagcaagtgcggcagaaattttacgaaagaaggtataaccggtataaacagaaccttcggcacgaataccggttttccattcaccgtaatctacggtatctggtaccagtgcccagttcaggctgtttacaaaggccgtgccaaaaaaggcgacacaagagaacatgacgaaagtgaaagagttacttccccagaaataattcagtatatcacccaccgcccacagcaccatgccagccagataaacctgttttttaccaaaacattttacagttaatggcaccagtaatacgccgatgaggatgcatcccatactgaagaatcccatccacgacaataaattaatatcattcagcacatactgggtgtaatagacctgaatcgccagtttgatattaaatgccgccagggtacacaagttagcaatgcataaaaccagcaatggcggattccgaaatatcgcgcaaaatgatttgagaatactggctttatgtccggttggcgttgtgtccacataatgctctttgacgcctctgtagcacagcatcataaaaataaagccgccaatggagaacataagtgccgcacaggcataaccgacggttgagtcagaaaaaagcgactgcaacggaataaacgccacggtacaaatcaatagccctatggttgcaccaccctggcggtaagccgcgagctgcgcgcgctcattcgggtttttggtaattgccgggatcatcgcaccatacgagcagttcatcagactgtatgaaagtccaaacatcataaacagcgcggtggcaatcgtcgttttaaccggcaaacaaaaggtggtggcgataaactggagcgttgcaattaacgccgccggaaccgctgcatataaaataaagggacgaaatttgcctttaggcccaatatttttccgcgagtcgagtaaaaatccggtgagcatatcggtaaacgcggtaaaaaacttcgccaccagaaagataatcccgccatagtaagcaggcatccctaattcatcggtataaaatttgaggagatacagagtaccgatgcagagcattaaattcgaaccgacgtcgcccataccataggcgattttttcccgcagattcagttttaatgtcagtggattatggtcagacataatcactccttataacgccccgcagggcgtcgtttattattattacgccgtgcgtttacgggcttctatctcttccacaatgcggacatacatcttctcgttcaggctgtagaagcaacccatcgccacaatggtgactaccgccagtgcgcttgggtagatgaagatcaactggcgtaacccttcaatggtgtggtcagcctgtgcgacgttcggcacatagccaatttgcgtcagcatccagccggggaagaaaccagccagcgcctgagacactttgcgaaagaaggtaaaaccggtgtagaccgttccttccgaacgcacgccggtgcgccactcgccgtactcgacggtgtcggaaaccagcgcccagttcaggctgttaacaaacgctgagccaaagaacgccaggcaggagaacgccacgaagctgaccgaaccgccgccgaagaaatagttgagcagatcgcccagcacccaaatcagcaggccgccgatataaactttcttcttgccaaaacgtctgactgaggcaggcatcaggaatacgccgatgaaaatacagcccatgctgaaaaatcccatatacgacaacaggatgggatcgttaagcacgtactgggtgtaatagacctggatggcgagcttgacgttaaacgcccctaaagtgcagaggttggcaatgcacagaatgaacagcgggcggttacccgcaattgcgcggaaagattgcagcaggcccggcttttgcgccggattagcaggctgggtttcgacataacgctctttcacgcccgagtagcagatccacataaacagcaggccaaacagtgaaaacagcgtggcggcgaagatatagccaagttgctgattaccttcgataagattcataactggcacgaatcccaccgtgcacagcagcaggcccagcgtagcgccgccctgacgccatgccgccagtgaggcgcgttcgttggggtttttggtgatagcgggaaccattgcgccgtaggagcagttcatcatgctgaaaaacagtccgtaaagcataaacagaatagtggccatcaccgttttaccggtgacatcaaacggtgtgccgacaaagttggcgatcgccagtaaggtgaccgggaatgacgcatacagaataaaaggacggaacttaccttttggaccgatcttgcgtcgggaatccaacataatgccggtacccatatcggtaaacgcagtaaagaattttgaaatcaaaaagataatgccgccataggtgcctggcagccccagaacgtcggtataaaacttcaaaagataaagcgtaccgatatccagcaggatgttagaggccaggtcgccaataccgtaagagagtttctctttaaagggcaggcgtaaagttgctggatcttccgttgtgatgtgactcatcgatgttctccctttgcccatgagtttccccacgggcggatgtgattagatgctttttaacgacgcgaacagtgccgcccattcgctatcggcgcgataaaagaccggcggcttgccgatgggcgcattaacggtaacttccccgccccggaacgcttcacccgtccaggcgtggacccagttatcctccggcagatagagcgtccagtcgctacggccttcttcatgcaccggagcgaccagaatgtcgcgacctaacaggtactgatatttcagggtgtaagtgtgcgcatcgtcttcgtaatgcaggaacagcgggcgcataaccggcaggccggacttcgcattcagcgcgacggcctctttcaggtaaggtttcagggtggtgaagacggtggtcatacgggcgaaatgggcgatggtttctgcgtcgccgtcaaactgccagttgtcgccaggacggttaccttcgtgggtgcgcatcatcggcgtgaaggcgctgaaatcgcaccagcgcagcagcagctctttgctgcgcttcatctcaaacagggtggtgtaaccgccaatgtcgctgtggtgcaggccatgtccggtcattgccagcgacagcgccgccgggacaaccgacgccaggccatcgtcgagactccagtcgacgttctggtcgcccgcccacatcatggtggagtatttctggctaccggtagaaccggcgcgcataaagaaaaggatctcgccgagcttgcccgtttcttcaagggcttcgtagttacacttcgcccacagcgcaggccaggcgttatgcataatttcggcactgacgccgttatgcaagtacgtgtcggtgggcagatactcgccgaagtcagccatccagccgccgcagccgagttcaatcatgttctttttgatcacttccttgaaccaggcgtaggcttctggattagtgagatcgacaacgccgccgtaaaactcgccaaactccaccagatagtcaccgccagaggcatcttttgccagatagccgtgttgtgccgcttcttcgcagagatctttatcgctggcaacatacgggttgatataggccaggaactgcacgccctcctgattccactgcttaatgcgtgaatccagttgcgggtagttttcgctgttccacttccagttccacatcacgcgtttgccaaaagaggtcatacgaataccggaccagtcctgcgcccagatgccgttgaccttcacgcccgcgttacgcatggtgtccagtttcttctggcacacttccgtcccgccctgaatgccgagcgttactccgtcataaatccagtcgggcagttctggctggcgtcccagcagggcggttaatttttccagcagggaaatgtatgtgtcagcacattcaaaacgcagcgttgctttgtcttcccacagcgccagttcatggtattccggggcactaaagtcgaagttcatatagcaactgttatcaacatggcagtaatacttctgcgtgctgacaaacgtaggctgtgggaagaaagtccagtaatagtcgccgcccgcattttctttgcagtcggcctgccaggtgacataggtttgtttgttgcgaccaacgccttgttcactggtccatagcgggaacggtttgccacgcagatcgaagtaggaaaactgttcgccgcagccgtagatatggtcctctggttgagcggcaaggcgcagccagatacggttgtggttaaggttgtcgttttgtagttccagcaataaacgcccctgatcgtcggcagagatattcagcgtggcgctaatgtcagaaccacggctgaaatgaattaaccaaccatccggtgactggctgacgatggcgtcggtaagcgcaattttctcctgtagtttatctttaatgctgaaattaccgcggaacatatcgatatccgctatacctgagccaatccataaacaaggattatctttgctatgggttaaaataagacgttgttgaaaatgtagggtaaaactgtcgttattctgatgaaattgaaaatctaataactgtggacgtggcgtatccataactaatctccatagagttgagaacgagattgttgccttcctgttattacaggcttatgtaaaatgattctcataaaactgatatataaaaactttacagaagctgagctgtttttaacttaataaattgaagatacataatgttgcctttagcgagtgaaatgttcttcaatgattttgactgctaatcaatacaagttattttctctgtccgtaaatattaaaaaacaggcggtgcggttttcctgattccagtaataataagtcgatacctgaattaaaggcgttaggcgggcaactcataggttcaactgccagtccctgacgctgtaatttttcaccgctataaacctgcacccagagttgatcggaacaaaggcttaccgaaagcgcctgctgtggatgggtaatggtcatttcccacaaatcattagcggttttaaaggtgtggtcgatttttgtcgcggctatttttttcgcctgcgtgaaatttaaatccagctcatcaacgtggtgaagcgttgtcggattcgcgtgctcatcgacggcataaacctggtttgccggaagctggaacagatattcatcaacagatgttaagttgcaggttaaataaggatgaatacccacgccataaggcgctgcgacagtgccgatattctggcttgcgatctcaacggaaagacccgtgtgtgcgttgagcgaataaacaacttgtgaagccagcataaacggatagccgtaactgggcggcagaaaagctgtcagggtaacgctggtggcggttaattcactaatttgccagtctcgccaggcaagcagcccgtgaatagcggcttttgaactatgttcattaatgggtaactgatattcctgcccctgatagcggtaacagccgttggcgatccggttcggccacggaataagcactttacccagatgcgccagcggcatctcttcgggtttgtgcgggatgactaaatgacaaccctgaaaggttaattcagccagaccagcaccgacggtcacaatggtcgcgtgataatcccccgcggcaagtgaaacggtctgtccactgcaatgcatattggtgatttgcatacaaggcaccttaattaacgacatacagcctcccgtgaggctgatgtcaaacccaaaaactgcaccggacggtcccctcgcccctttggggagagggttagggagaggggaaaacccgcaccctattttcagatcagttatttcgcattaatatccagcagacccgctgcaaccgctggagccatgccgggcgctaacgggatacgcgggatcaccaggcaatgcagcaggtgataaatatcctgtttgccgtcccagactttggtggtgaccttattgtccgcatccagctcctgccaccaggaaccattttcatagtccatcaggtacttaatgcagtactcccaccatgtttgataccaggtttcatactggcgatcgccagtgacggtgtagagcgcgtaggccgtacccattgcttcgacgataggccaacgtacacgttcgcggaccaccggttttccttcccagtcaacggtataaacaatcccgtccgcgccatcgggtgcccaggcatcgcgcacggtggcgttaaacagacctttggcatcttctagcagccatgctggtggttgttcgcaacgggcttccagggcagcatggatgtgcagcattaaacggccccattcgatccagtggcctggtgtacctccgaacgcgcggaagcgatgcgccgggttatctttgttgtaatccggcagcggattccactgggtatcgaagtgttcgttaacgcgataatgattatttctggcgacgtcgtggataatcacggaagccacgcgaatcgcgcgatccagccattttttgtcgtgagtgacgtcataaacaatcaagaaagcttccaccgcgtgcatattggcattgccgccgcggtactcttcggttttgctgaaggcttcgtcccaggattccaggcacatctgctcttcttcgctccagaaatatttctcgataatttcaatggtgtaatcgagcagcttgcgcgcttccgggtgacccgttgtgacggcgctggcggcacccagcagagcaaagaagtgttgatagccctgtttggaggcatccaccacgccctcgtcattcacgcaggcataccagccgccatattttttatcacgcagtgcgccgttcatggctttgataccgtgatcaaccaacgagtaagcgccaggtcgacccatcgccgcagcaacggaataaacgtgcaacatacgagcggtgatccacagatgggtgcccatctcttctttgatttgccctttattgcctaaccagccaaaaccagtcggcactacggaatttttaccaaaatcaaagatgcggtcggtttcctgttccagccaacggttgtggcttagggtgttaaaccatttcattccttttatcctcatcttagcggcgtttagccatcatttcgtcgacgatatcgccaagttgttgtaatttcggtgcgcaaacgtcacgcagcatcagctcgttgtctggtaaaccgacgaccgatgcccagactgcacggcctgccaggaatcccgatgcgcccgccgtcattgccacgcgtacggcacgcgggaacagtttttcgtcgacaccggaagagaggatcacccatggcatattgatatggtcattcagacgttgtgaagcacagagaagctcttgttgcggacctttgccataaagcggcatttcaactttgtagaggtcagcgccactgtcgcccagctctttggcggcatcgatgatcgcttgttcgcgatcgaatttatcgccacgacgcggtgggcggacgactggctcaatgatgcttaccagaccgtgtgagtggcacagttcgttgaactctttcaccatatccagacgttgctgcgcatcttcatcactacgccacagcaccagcagttttaaggctttgccaccgtcttgtttgatctgtagcggattgattttgcggtcaataaccacgctatcgaccggaataccgttgccaggaatgaactcatcggcggcgacaatcatggcgcaacttttggcaatcgcgttttgctcaaccacctggcggtagcagaattgttgatctaccagaatcgccgaggcataaggcgagagggcctttgcagcgttaactttgaaatcagttaaaacgctatcggctaccggagcgggtgccccagccgcggcaaacatcatgcgcatggcttcgcgctgatcgaccgccagcatggcaaaaccgcccgatgcgcgcgtaatgtcgttgatggtgtacttattcattcatttattcctttatccagtcgttacatttttactttggcagtcatcccggcactgacacggacctgttccagaatggcggaccagtcctggcgaccgcgacccgctgcgcgcgcctggctataaacctcccgtgaggcggcccccagcggcattggcacatgcagctggttggcgacatcaagggcgatgccaagatccttatgggcaagatcgatcatgaaggcgggagaaagatctccgctgaggactttgtttggccaggaagtggtgaagtgacctttaccggcggcggtaccgctcatcactttgacggcaacatcgaagggaagattcagggcttcgcacaaaacggcggcttctgccgaaagcgcattgagcgcgatgctcatgtagttgttgatgagcttaacgcggatccccatgcccggaccgccagcgttgatcaactcactgcccatcgccatcaggatcggtgtggcacgttcaacttgttcagcggtgccgccagccagcagtaacagagtaccggtaatggcatttgcagaagtacggcctaccggaacatccatcatgctgaagcctttggcttgcatatcggcaatcaatttatcggtttgcagcggatggatggtggacatatcaatgaccagcgcatcggtagataagccttcgcaaacgccgttttcaccgaacaacacgttgcgcaccagatcgccattcggcaacatggtaatgataaattcggcatctttagcggcctgcgccgggttggcggcgggagtcgcacctttgtctaccagatgccgcacagcttcggcgttcacatcaaagacgcgaagttgatgcccttgctgcaataaattgctcgccattggcgaacccatttgtcctaaaccgataaacgcgattgctgccataaccctctcctgaatacagttatgtcactttttgtcatttatgacatgctttgcttgtctgtttttgatcgtatttgtaatttatcgtcaaaaaattgacagccgtcactttttaaacaattggtgaaattaaaatgaacgcatcccaaaatgtttaaggaatgaccatgattcgtgttgcttgtgtaggtataaccgtgatggatcgcatctattacgtggaagggttaccgacggagagcggtaaatacgtggcgagaaattatacggaagttggtggcgggccagcggcgacggcagcggttgcggcggcaaggctgggggcgcaggtcgattttattggtcgcgtaggtgatgacgacacgggcaacagcctgctggcagagctggaatcctggggcgttaacacccgttacaccaaacggtataaccaggcgaaatcttcgcaatccgccatcatggtggataccaaaggcgagcggataatcattaactaccccagcccggatctgctgcctgacgcagagtggttggaggaaattgatttctctcagtgggatgttgtgctggcagatgtacgctggcacgacggcgctaaaaaagccttcaccctggcccgtcaggcgggtgtgatgaccgttctggacggggacattacgccgcaggatatcagtgagctggtggcattaagcgatcacgcggccttttcagaaccgggtctggcgcgcttaacgggcgtgaaagagatggccagtgcgctaaaacaggcacaaacgctcacaaatggtcatgtctatgtgacccagggtagcgcaggctgcgactggctggaaaatggtgggcgtcagcatcaaccggccttcaaagttgatgtggtagataccacaggtgcgggtgatgtttttcacggcgctttggcggtggcgctggcaacaagtggggatttagcggagtcagtccgcttcgccagcggtgtagcggcgttaaaatgcacacgtcccggtggacgagccgggatccctgactgtgatcaaacccgatcttttttgtcactttttgtataaaatgccagggtgatggtttttcgaggaattttcatgagccttaccgaactaaccggtaacccgcggcacgaccaactcctcatgctgatcgccgagcgtgggtatatgaatattgatgagctggcaaatctgctggatgtctccacgcagacggtccgccgggatattcgtaaattaagcgagcaaggcctgattacgcgccatcacggtggcgcgggtcgggcttccagcgtcgttaatacggcgttcgagcagcgtgaggtttcgcaaaccgaggaaaaaaaagcgattgccgaagcggtggcagactatattcctgatggttcaacaatatttatcaccattggtacgactgttgagcatgttgcccgggcgttacttaaccataatcatttgcggataatcaccaacagcctgcgtgtggcgcatattctttaccacaacccgcgctttgaagtgatggtgcccggcggtacgttgcgctctcataatagcgggatcattggcccttcagcggcgtcctttgtggctgattttcgtgctgattatctggtaacaagcgttggggcgattgagagcgatggcgcgttgatggagtttgatgtaaacgaagctaacgtggtgaaaacgatgatggcgcacgcgagaaatattctgctggtcgccgatcacactaagtatcatgcttcggcggcggttgaaattggtaacgtggcacaggtcactgcgctctttaccgacgagctgccgcccgctgcgctaaaatcacgcttacaagacagccaaattgaaatcattcttccccaggaagacgcgtagatttttgtgaccgttaacctggcttcataccttgccacatagccaaacccatcctttcccgctacagttaatttcttgtggcgcgaaaggaggcaaaaatgctctatatctttgatttaggtaatgtgattgtcgatatcgactttaaccgtgtgctgggagcctggagcgatttaacgcgtattccgctggcatcgcttaagaagagttttcatatgggggaggcgtttcatcagcatgagcgtggggaaattagcgacgaagcgttcgcagaggcgctgtgtcatgagatggctctaccgctaagctacgagcagttctctcacggctggcaggcggtgtttgttgcgctgcgcccggaagtgatcgccatcatgcataaactgcgtgagcaggggcatcgcgtggtggtgctttccaataccaaccgcctgcataccaccttctggccggaagaatacccggaaattcgtgatgctgctgaccatatctatctgtcgcaagatctggggatgcgcaaacctgaagcacgaatttaccagcatgttttgcaggcggaaggtttttcacccagcgatacggtctttttcgacgataacgccgataatatagaaggagccaatcagctgggcattaccagtattctggtgaaagataaaaccaccatcccggactatttcgcgaaggtgttatgctaaaaaccattcaggacaaagccaggcaccgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttacgtcactttatttttgccaactttctgcctgctactggcgatgttattcagcggtatatcgaacaatttgttgccaattccaacaagatgaccgccgttggggcgtgcgggctgatcgtcaccgcgttattgttgatgtactccatcgatagcgcgttgaataccatctggcgcagtaaacgagcgcgaccaaaaatttactcgttcgccgtgtactggatgattttaacgctggggccgctgctggcaggggccagtctggcgatcagttcctatttgctctccctgcgctgggcgagcgatctcaatactgtcatcgacaacgtgctgcgtatttttccgttgctgttgtcgtggatctccttctggttgctgtacagcattgttcctaccatccgcgtacctaaccgcgacgcgattgtcggcgcgtttgtcgccgcactcctgttcgaagcaggaaagaaaggtttcgcgctttatatcaccatgttcccgtcatatcagctcatttatggtgtgctggcggtgatccccattctctttgtttgggtctactggacatggtgtatcgtcttgcttggcgcggaaattactgtcactctcggggaataccgcaaactaaaacaagcagctgaacaagaagaagacgacgaaccatgattgcattaattcaacgcgtaacccgtgccagcgtcaccgtggagggagaagtgacgggcgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtgctggtggtttcccagtttaccctcgccgcagataccgaacgggggatgcgcccaagtttctccaaaggtgcatcaccggatcgcgcagaggcgttatatgactatttcgtcgaacgctgccgtcagcaagagatgaacacgcaaacaggacgcttcgctgcggatatgcaggtatcgctggtcaatgatggccccgtgacattctggttgcaggtatgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtggcggtaggccgactgtatattaatgccgacaatgaagcgtccattcgctttatggccgttcatcccgacgtgcaggacaaagggttaggcacgctgatggcgatgaccctggagtcggtggcgcgtcaggaaggcgttaagcgcgtgacctgtagcgcccgtgaagacgcggtggagtttttcgccaagctggggtttgttaatcagggagaaatcaccacgccaaccaccacgccgattcgccattttttgatgattaagcccgtcgccactctggatgacattctgcatcgcggcgactggtgcgcgcagctgcaacaggcgtggtacgaacatatcccgcttagtgaaaaaatgggcgtgcgcattcagcaatataccgggcaaaaatttatcactaccatgccagaaaccggcaatcagaatccgcaccatacgctgtttgccgggagtttattctcactggcgacgctcactggttggggacttatctggctgatgctgcgtgaacgccacctcggcggaacgattattcttgcggatgcgcatatccgctacagcaagccgattagcggtaaacctcatgcggtagccgacctcggtgccttaagcggcgatctcgaccgtctggcgcgcggacgaaaagcacgggtgcagatgcaggtcgaaatctttggcgacgagacgccgggtgcagtgtttgaaggcacgtatatcgttctgcccgcgaagccatttggcccgtatgaagagggcgggaacgaagaagagtagctgatggagaggggcggtgctgcctctctcattcaggtcatttatattagtccttggctatttcggttatattaaataagaactctataaatttttattcttcgttggctccatacgtgtcttgctacatcactgttcaggagcatttaaatattatttgtagaactgagtggcaattatcgcagataatgcttaattcatcatcttagttcatgtttgagcgatttttgatagtcaaaaccccctctggtgccatacttttctcataaatatttttaaaatctatagctaacaaatattatgcaaagataatggactagcatcattgtcagtatcattcatttactgctctgtatgttatgaataattatgttgtatgtttgctcttaaaccgtgggaaggaggctataatggttgccaatattaatctcattaaacaagaaagttattctgttgttaatttagaaaaacaactttcccgaactgttaccaacaaaattataacgatgagcaagtaaagaccggttggtggcagtactgaccggtctgtgatgaaagattaatttcaccttaaatcctggtgctgttaggatgctgacgtttttcggctacaccattcagattatgcaaataaatatctctgaatataatatattcatagcacccataattcatcctgggcgataactaaaccatttttgagtaataaatgaaacaactgcaacactcttattatttctggaaaacgcctcgcaaaaacaaaacaacatgcaaaaatccgctttttttaaatgattttccggcgtaattttcgcacatacattaatgagtaatatatgtaaggtattggtaatggcgatgaatacggtttttcttcatttatcagaagaggcaattaaacggctgaacaagcttcggggctggcgtaaggtttcacgatctgcaattttacgcgaagcggtagagcaatatctggaacgtcagcaattcccggtgcgtaaagcaaagggaggcaggcaaaagggggaggtagttggtgttgatgatcagtgtaaggagcataaggaatgacaaaaatttttcattcttgaatataaaaaacagatgcccttattctggtattaatacaaggctgttttacttgaacttataataactgcaactgttacatcatatctggaaaacgcctcgcaaaaataaaaaatgatgcgtaaatgagctttctttaaagattcggcaagggtacttttctctccatagattcaaaaatgatattggcgagatatttatgaactctctggcaggtatagatatgggcagaattttactcgatttatcgaatgaggtgattaagcaacttgatgatctcgaggtgcagcgtaatcttcctcgtgcggacctattaagggaagcggtagatcaatacctgataaatcaatcgcaaacagcaagaaccagtgttcctggcatctggcaagggtgtgaggaagatggtgtcgaatatcagcgtaagctgcgcgaggaatggtaatgggaaaaaatgatgtcaatcagattgctgacaacgtgcgcgttgttcatgccggatgcggcgtgaacgccttatccggcctacaaagtcgtataaattcaatgtattgcagtttattggtaggcctgataagcgcagcgcatcaggcaatcttacgcttgtcatcagtctcatgcccataaccttattgatgtggtggtgggtaaattgaggccaaaccggcactggcggcatagcttgaggtggtaacgcggaatacgagagatggtgtcgtcacaccctatgagctgtaatccgggcgacctgcgccacccggaaaacgtcagagattactctccttcacccggaaacaggaacgggttgatggaactgcgggcatagccttcttgctccattcgtgcgtccagtaccagagaggcgaggtcatctgctacggcttcgatttttggatctttttcctgatagagaattttcaggtaagtgtcgcagtcatcgcagctttcggctttaatcgcggcctgttcgtcatccagcgaccagtaatgcagtttgccgctctgctcgcagttgctgcattttacgcgcactacgtgccattcagtttcacacaggttgcagtgcaggtaacgtagcccctgagtggtgccaatttgcaccatgctggacaccggcatagaaccacaaaccgggcaatattgacgttgctcgccgtattcagcgcgggctttgccggggatcagattggccatctgcgcccagtagagcgacagtgcagcccagataaacggcgctttatcgctgctgacggacgagaaatcagaggcaaacagcgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgcagtcagatccatctccagcggatggtcgtacagcaccacttcctgggcgtgggcgataagcgcagcaaagcgcaggtaatcacccagaggattattttctgccagctcgcgcagacgctcggcgcggcggttgtataaattcttgagccgagggaacaataacggcggaatcatatccgccgtacgtttctcgcttgaacccagctcatcttgcgggattatgcgaatactcattcagctttcttttccgttgtcttgcggacctcacggtaccagcgcgggtgatgtttcttcgcccaggcgctggtaacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcagcagaaccaggaaaataatcgccgcccagaaaacgcatttctgaccgaagttataacgcccggtgtcacctacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaattcgcgccagctgcggtgtgcccatgatttgcatcaaccagttgaaggacgggaacaaaaagcccagcccgctcaccgccgccaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggccgcaaaggtagccgcaaagccaacagccgcgagcggtttccagatgcctttccagaatttcacggtttcgctgatttccgggttctccggcaagccatgatacagatttggcttgtcagcatggtgcagcacgtacatgacgtgtgtaccaccgacgcctgccggatcgtacagacccgcattgtcgtaaccgcgggttttcagctcagcaacgcgctcgctcgccagcgttttcatcgactctttcgtaccgaagtgaatcgcgcccgttgggcaggtcttcacgcaggctggttcttgcccaaccaccacgcggtcaacgcacagcgtacatttgtagacgcggttgtcttccgggttgaggcgcggaatgtcgaacggacagcccgcaatgcaataaccgcagccaatgcactgctcggactggaagtcgacgataccgttggcatactgaataattgcaccttccgccgggcacgctttcaggcagcctggatcggaacagtgcatacagccgtctttgcggatcagccattccagtttgtcgttctgctccacttccgagaagcgcattaccgtccacgatttggcgcttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgagattgataagccatatgtcgtctccgttacaccttttccacattcacaaggaaggacttaaactccggcgtctgcgtgttcgcatcaccaacgaatggcgttaaagtattggcaataaagccttttttagctacgccttcatagccccagtgaatcggaataccgatggtatcgatatctttgccgttcgctttcagcgtgcgaatacgtttggtcaccaccgctttggctttgatatagccacggttggaggagactttcacggtatcgccctgggcaatgccaagtttattcgccagcgactccccgatttccacaaactgctctggctgcaaaatcgcgttcaacagcgcgtgtttggtccagtagtggaagtgctcggtcagacgataggtggttccgacatacgggaacttatcggctttacccaatgcttcggcgtcgtctttaaagatacgtgcagccgggttcgagataacgtttggatgcagcgggttagttcccagcggcgtttcaaacggctcgtagtgttccgggaacggaccttccgccatcttatcgagggcaaacagacgccccatgccttcctgctgcatgataaacggcccgacgccgctacccggaggcgctgcgctgtagtccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacggcgtgccatctggttgccttccggcgtccagctaccggcgaaaatccagcagccacaggaggttgtaccgtcatcgcgcaattgggcgaacgaactaagttgttggcctttcttgacgataaccgcaccggttgccggatcggtaatatcggccagcgccttaccgttgctctccatcgccacttcttctgaagatggctcatgcggaatggcgtagttccatgtcatgttcagcacctggtccgggttcgcgccaccctgttcggcatacatcttgcgcaagcgcaggaagataccggagaggatctcgccgtcagtcagcgcaatccccggggcgtccgcacctttccagtgccactgtaaccagcgacctgagttaacgatagaaccgttctcttccgcgaagcaggtcgatggcagacggaacacttcggtctggatcttcgacgagtcaacttcgttcagctcaccgtggttctgccagaagttagaggtttcagtgttcagtgggtcgatggtgacgaggaacttcagtttcgacagacaaccgatcactttgtttttgttcgggaatgaggcaacagggttaaagccctggcagatatagccattgaccttgccctctttcatcatctcgaagtattgcaggacgtcgtagcctttatcccacttcggcaaccagtcaaagccccagctattttccgccgtcgctttatcaccaaagaaggccttcatcatagagacgaagaatttcgggtagttgccccagtagtttacctggccttccagcagcggttttggcgtgttggcggtaaggtaggtttgcagatcggtctgcttctcgcttggcagcgtcatgtaacctggcaggctctgcgacagcagccccaggtccgtcagcccctgaatattggagtgaccgcgcagggcgttaacgccgccgcctgccatccccatattgccgagcagcagctggatcatcgccatcgtacgaatgttttgcgcaccaacggagtgttgcgtccagccgagggcatacaggaacgaggcagttttatcgtgagcactggtttctgcgatgtattcgcagactttcaggaacgcgtcttttggcgtaccacagatgttttcaaccacatctggcgtgtagcgggaaacgtgctgtttcagcaagttccacacgcagcgcggatgttgcagcgtggtatcgcgtttggcgaagccgttttcgtccagttcataagtccaggaggatttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacgaataggggcatagtagtcagctaccgccgccgtacgcgtaaagcgaggatcgatcacaatcagcttcgcgccgttgtgaattttggcttccatcgcccagcggaacccgaccgggtgagcttcagcggcgttaccgcccatcaccacgacgaggttggcgttcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgctgccatttatcagaacctggcgcacggtattccggaaacttcagacggctttcggagtggatgaaatccaccaggccagcgcctttcggacaaagtgcaccgcggttgaccgggtgatccggatcgccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaagggtttgtaacagaataccataatgttggtgtgtgtgttcttatctggttaagagaaagtgaaaaaaacacagcgaaaagaaatcgaaaatgtgacaaatatcacaggtgttcgtcaaattgagttatggcggcgtgatgatttacaacacccacggttagatgaggtcgcggaagaagttcccgttgcgctggtctacaacggcatttcgcatgtggtgatgatggcgtcgcccaaagaccttgagtactttgcgctcggtttttcgctttccgaggggattatcgaaagtccgcgcgatatcttcggcatggatgtcgttccttcctgtaatggtcttgaagtacaaattgagctttccagccgccgctttatggggttgaaggagcgccgccgggcgctggcgggacgtacgggctgtggcgtatgcggcgtggagcaacttaatgacatcggaaaaccggtgcagccgctaccgttcacccagacgtttgatctcaacaaactggatgatgcattacgtcatctcaacgattttcagccagtggggcaactgactggttgtactcacgccgctgcctggatgttgccatctggcgaactggtcggcgggcatgaagacgtgggtcgccatgtggcgctggacaaactgttaggccgccggtcacaagaaggggaaagctggcagcaaggtgcggtactggtttccagtcgtgccagttatgaaatggtgcaaaagtcggcgatgtgcggcgtagagattttgtttgcggtgtctgccgcgaccacgcttgctgtagaagtggctgagcgctgtaatctgacactggtaggtttttgtaaaccgggtcgggcaacggtttatacccatccgcagcgtttgagcaattaattaaaataagtcctgcgaaatatattaaattgcaggacttattcatttcgtgaattttattattttatttataaacaaaatgcgtgtagtggcgttttcttttttcatttattatgttcactctcttatctatatatttataaggcaattaaatgaaaaggaatttattatcttccgctattatagtcgccatcatgtccctcggtctgacgggttgtgatgataaaaaagccgaaacagaaacgctcccgcctgccaatagtcaacctgccgcaccagctcctgaagcgaaacctactgaagctcccgttgcaaaagcagaagctaaacctgaaacacctgcgcaaccggtggtcgatgaacaagcggttttcgacgaaaaaatggatgtctatatcaagtgctacaacaagttacagatcccggtacagcgcagtctggcgcgttatgctgactggctgaaagattttaaacaggggcctaccggtgaagagcgtactgtttatggcatctacggcattagtgaatccaacctcgctgagtgtgaaaaaggcgtaaaaagtgctgtggcgttaacgcctgcgctgcaaccaattgatggcgtggcggtgagttatatcgatgctgccgtggcgttgggtaataccattaacgaaatggataaatattacacccaggaaaattataaagacgatgcgtttgcgaaagggaaaacgctgcaccagacattcttaaaaaatctggaagcctttgaacctgtagccgaatcttatcatgcggcgattcaggaaattaatgataagcgtcagcttgcggaactgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctagtggcgcaggccaaagaagcggataaaggcggcatgaatttctcgtttattaattcggcaggccagtatcaactcgaggctaaaaaatacgttcgccgcatcagagataaagtcccgtactctgactgggataaagagcaacttcaggacgcaaactcaagctggatggtcgaagactctttcccgagagcattacgcgagtacaacgaaatggttgatgactataatagcctgcgttaaacgtttttgatgataaatgcagtgtcggatgcggcgcatccgacacagttcaccccttgtgaagtaactccataaatgcctcatatcctgttaacccggcaataatctccgccggatgctgacacaatatgcttgccagatagctaaatatttttagctcatgacgcgcatcggcggcggcgcaggcgatcaagacatggttaatgacttcgttattcacctcaactggttgggcgagggtaataaaaaatccacgaaaacgtcgctcctgttcgctccagcaatgtgggatggcgaggcgattaacaatcaggttttcaccttcgccttcgcgggcgatgatgcgttgtgcttcatcggcggtaatatggtgttgtgcgactaattgcgcacaaatttgccgggtaatatgttgccagctttcaccgcgtacattcgaataatgaaaacttccgggggcagagaaaaaacgctccggctgttggcgaataaatgccgtcgccagaaaatgttttatttgttcgataccggcagccgtaatgatattttttacggtgatgtaattatttaccgcgtcatccagtaaataatggctgttgttaatgatcaataacggctcaatctcttcgcgaatggcaacaagttcgcttaagctacgggcaataattacccgacaatttaaaacatcgcgctcaatggcgagctgattaatagtggcaatcgcgttctggtccgagagcaaaatgatcggctggcgttcgttttgatgccgctccagcgcacaggcaaaatacaaaccgatcagatcgctgtcgaaaaggggaatatcgagctgttcacgcagtagcgtaataaagtgcagactcatatcaaaggccgcaggccaggcggctttcaggttattcatgctgctctggcggtgctcagcaatccacactggtgcggcaaggcaacgtaataaatgcccggtaatattctcaaccagctgcgcatcaataatattcaatgacgcgatgcccggcaccctttgcagcaacccctgcacattatcggctgaaattacctgcgcttgctgatgctgtttctctatcaaacccgtcagggttcttacagcgttatcaccaagaaacagaccgctatgttcaacgatttgttttatctcgtcaccgggatattgcggccactcatcggtcagttgattacgcagggcgtaaatcgccagaatcaggctggagagataatcaccctgcatgagcggccagcggtgttggttgtcgcaggccgtggataaatgctgaaggttgtctcgtgttatgcccgccagcggaattaaaaacggatctttgcgcagcaagttcgccagcaagataacgcgtttctcttctgtctcatcaatgaaatggcccaaaccagggcggctggccaggcaacaagtgcgttcataacgctgttttaaccggggcagacgctctgctacccacgtttctggcaaattaagcgccgaggcgagttgcgcacggggagtgaaagtattcagtaataacagcgccagcagccgatcgtcgttatcgtgcttttgcagcaactgaaaaaagctgcggcgctcgaagatttccagctgatagcccgcactgccactggcgaaaatgcgggctttgccgttaagggtgaagttgagatagtcaatatcacgcaggatggtcctgcctgaaacgccagtctgttgcgccagctcgccaggcgtgcgcggctgttgctccagcagatcgacaatctttaactggcgttcgtttagcattaatccacctgacggaactggctaaacgcgttgactttctccgcagttaaggtcgtcagaaaaccccgtatcagcgtgagcagagcttcgtaatcggcttttgaaatcataccgctgttggcgtgcagataacgagttggcagacacagcgcgacaaccggacgcccgccgcccatcacgttgtagcgcccgccatccgtcgcaccggttttcatggtggaaaattgcagcggtaaatcgttatgtgcggcacagctttttaacgctgctaccagtttctggttggggaagtagcgcttgtcaaacagcatcagccccggcccctggcccagtttcagcgggtatttaatgttatcaatgcccggaacatcgcccgctacggcggtatccaacacgatcacgacgtccggtttaatgtgttccgccgaggtttgcgccccgcgtagcccaacttcttcttccacactgccaacgccatacagcgtaatttcgggattattcaccgtctgcaatagttcagccatcattgcgcagccgatgcggttatccaacgccttgccgaccactttatcttcgccccagcaggcaaaattggcttccgggctaataaaattaccaatttccacgccgcgcttttccacctcttcgcgactgttcgcgccaatatcaatgaacatctcatcaaatgacagcggttgttgcttttgcttttccgttaacgcatgaggcgcgacggaaccaatcacaccagggattttcactcccttgtgtgtgcgtatggttacccggtggttgagcatcgactgattccaccagccgccaatggtggtaaaacgcagaaaaccgctctcgtcgatgtgggtgaccataaagccgacttcatccatatgtccgacaacggcaacttttggacctttattccccttacgggcaacaaagctgcccagaccatcgaaggtgatttcattcacgcaaggttccagcgtgtttatcagaatgtcgcgaacttcctgttcatcgccgctgacggcgctggcttcgcacaactgttgcagtaactcaatgttcatggacaagctcctgttgcgcggctttcgctttgcggcgtaaccacaatcctttcaggacgataatgaatgaaatgttcagcgcgaggccaatcgccagcaccagataaaacgaacccaccggcgacatcaggccgatcagcgggtcaaagatacccaaaccaggtgccagacgtttgattccgaaagcgatcaccagcacgccggtaatgccgcccgccagcgtattggcggtaatcatcggcaacggagctgccagagcgtaaggaatagccggttcggttgcgactgtggcaccgaccacaatggcactactggcagcctctttttcctgtcgggtaaacagtttgggcgcaatgaacgtcgcaagacccgccgcgacgggcggcatcagcgcgacaacgccgacgatggcgtaccagtcataaatgtgtttttccagcagtgagaagcagaagaaccaggcggttttattgatggggccgcccatatcgaacgccagcatcgcaccgaccagaaacgctgccgcaaacttcattgatggaggaatggtattcaggaagtggagcagcccgcccatgaggtcggacatcaccggcccgataacgtagtaagtgagcacgccgaaaaccagcagagtaacgaacgggatcagcattgaaccgagcagcggttgtaatgctttgccaaggcgcactttgcggaaccagaagacgaaatagccaatcgccagccccagcaccaccgcgccgaggaatcccgcacccgactgggtgccgagcagcgctttgtcgttcgccagatagcaaaccagaaacgccggagcgaaagccggtttatcggcaatcgacgaggcaatataagcgcccatgatggggatcataaaggtgaagccaaggtaaccgatggattcaactacccaggtaaacgacggcgcgcctttcgacatatcggtatacggcaaaccgaactgcaccagcatgttggcaagcgccaccaggataccaccgccgatgacaaacggcagcgccgcagagacgcccgccatcaggtggctcatcacgctaccgctttgcacttcctgtttgccaagcttcacgccgctatctgcggcaaaaagctgcgagtttgtcggtaattcgctgaaaatctggtcgatatttttcaacgcctgggagatggcaatctcataaactttcttcccggcaaaccgcgcgcgatcatcaccgctcaggccacgcccggtagcgagaatgacgtaatcggcagcggcaatctcttcgctggataagcggttttcaacgccactggacccttgagtttccacttttatggtatgaccgagagaacgggctttctgttccagggcttccgccaccatgtaggtgtgagcgatcccggcggggcagttggtgatcgcgacaatacgtaaggatgactccatcgccacttccttatgagctgagggtttgatttaacaaggcaagcacctggtcggtatcgccctgttgcagttgatgaataaattccttgtgaataattttgcgacacagtgtgccgatgattttgacctgatcctcttcgccgctttgcggcacgccgaggcagatccagcaattgacgtcttcgccatcgctggctttccagtcaatagcctgcgctttgcgggcgaataatacgaacggttgtttaacgcaggcgcttttaccgtgcggcacggcgacaccggaaccaaatccagtagagtgcattttttcgcgcagcagcagggtttgcaggaactggtgtgagtcggtgataaaaccgttttgtaacgctattgtcgccaactgcttcagaacggaataagcgccattgccctgaatattcaggtcaatacagcttgcagtaagagctgccattaatcggactccataaaatatattttaatcaattgtaatggtggagcgattaagtgatgagaggcgatatgtcggtaaacaatgacaatttgagacagagtgaaaggtcagatttgcggagtaatgcacataatggttatttaaataaaccacatgaatcattaatgggttattcattatttttgtgatttactcacaatgtatcagggaaatataacttaccgggagatgtaatatgtttaatttttcaaatcgaaatttaaaatattgtgccggaggcatctctggcacattgggcaattacggcaggtaaaacacttcttgcagctcgctactcaccgggctgttatccgggttagcgggcataacatcggtcatatatttccaccaacgttggcaaacatcagtgctggcaaccgcattccagcgttcttcagattcaatctctaccatggcaaacagcagattacgcgctttgtcgagatagatggcgtagttatgcgcaccgtgagatttcagcactgcttccagttctggccagatgggattatgccgacgctgatactcttcgtgggcgtcggggtttacctgcatgacaaaggctttgcggatcatgtttgctccttacagcgccagcgcactggcgagtggcgtaacgccgaaacgcttgccgagcgctatcaactcttcacggctgatggtctgtttcatgccgcccatcgaataaaccttcactaatacttgtgctgatttttctgcggtgtcgattaaaccgaaggtttcatccagcgtcggtccgctgccgaagacgccgtggaagggccacaacaccagcgaatgtttttgcatctcttgtgcggtcgcctggccgatttcgtccgtgccgggcaccatccacggcaaaatgccaacgccatccgggaataccaccagacactcggtgctgccttcccacagttggcgagtgaagaccgcggtgtcgttttcaagtacataggtgagggcgatcaggttggtggcgtggcagtgcatgatcacccgatctttgccgttggtggctttaatgcgctcgcagtgggaaaggaagtgagccggaagttcggaagtggggacggcttcgttggttaacccccaaagaatgtggtagcccgcgccgtcgctgtcgacttttacgatgcctaagttagccgcaggatcaagctggacgttacggaagaatttgcccgagccggtgacaataaacggtgtatttgccagtaaaggcatgggctggctgagcgggatatagcgcggttgttggtggaaattgtcgtgatatggtgcgatatcggcgtcatccaggcgtagcgtcaggttgccgccgttgcgctcatcccagcctttcagccaggcgtcggtggtggctttgatcattccctggacaaaccaggactgagtaatgttttgcatgttctgtgttcctgtaaattcggtgttgtcggatgcacgacccgtaggccggataaggcgctcgcgccgcatccggcaatcaatgcctgatgcgacgctgtcgcgtcttatcaggcctacaactattgccgacctgtaggcctgataaggcacttgtgccgcatccggcaatcaatgcctgatgcgacgctgtcgcgtcttatcaggcctacaactgttgccgacctgtaggccggataaggcacttgtgccgcatccggcaatcaatgcctgatgcgacgctgtcgcgtcttatcaggcctacaactattgccgacctgtaggccggataaggcacttgtgccgcatccggcaatcaatgcctgatgcgacgctgtcgcgtcttatcaggcctacaactgttgccgacccgtaggccggataaggcgctcgcgccgcatccggcagtgtttacccgcggcgactcaaaatttctttctcataagcccgcacgctctccagccattcgctacctgctggcgtatcgtgacgttggcaatacatttcccagaccgcctgccacggcaacgatttctgctcttccagcagtgccagacgcgcagtgtaatcgcccgccgcttccagcttgcgcagctcagcggtaggttccagcaacgcacgcagcagggcttttttcatattgcgtgtaccaatgacccacgcggcaatgcggttgatagaggcatcgaagaagtcaaggccgatatgcacccggtcaaacagatcgtgacgcacaatctcactggcaattgcctgggtttcatcatccagcagcactacgtgatcgctgtcccagcgaaccggacggctgacgtgcagcagcaactgcggcacatacagcatggcggcggaaatcttgtcggaaatcacttcagtcgggtggaagtgcccggcgtccaggcacagcgcagtctggcggctggtggcataccccatgtaaaactcattggagccaaccgtgtagctctctgcgccaatgccaaacaatttgctctcaacggcgtcgatatggtgcgcagggtttagcttctcgctgatcacctcatccagtgctgccagcagacgctgacgcggggcgagacggtcaacggtgatatctttcataccatccgggatccagatgttcatcaccgatggtgtgccgagttgctcgccaaaataggccgaaacgcgacggctggctttgcagtgatcaatccagaactggcgaatgctgtcgtcggcatgggaaagcgtaaagccatcggcgcttagcggatgcgaaaagcaggaggggttaaaatccagaccgagctgattggctttcgcccattcaacccagtttttgaagtgctctggtttgatctggtcgcgcgagactggcgtatctgattccagatagatggcatgtaaattaagccgtttcggccccggaatcagccgcatagcctgttccagatcggcacgtagctcactggcattacgcgctttgcccggataattgcctgtggcctgaatccccccggtcagcgaaccttccgggttttcaaaaccggaaacatcatcgccctgccagcagtgcattgaaacgggtaaacgatcaagttggcgcagcgcctcctcgacatcaatccccaccgccgcgaaacgctgtttcgctagctcccaggcctgttccagttgagtggtcatgcgcaaagctcctttgtctgtcgtgtagagtgaatctgcgccacatagtgggcaatttcactgtcaggattaggggtaaaggtggtcagattcgcggtggtgctgacgacctgacggaaatcatccacattgttgagttcatccagcgtcattaactggatgccgatattgccgagcgtcgaggcttcaacaggcccggcgatcacccgaataccgcaggcatcggcgcatagctggttgagcagcgtgttctggcagcctccgccgacaatatgcagttgcgagaaatcttcaccgcgcagctgcgccagctcatgcaacacatcggcatacagcagcgccagactgtcgaaaatgcagcgcgccagttcagcatcactttccgggatcggttgcgccgtttcccgacacgcagcctgaatttcgctgcacatcgtctcaggattaataaagcgatcgtcattgggattgataatgaagcggcaagccggaagtgcctgtgtcgcggagataagcgccggaagatcgttgatttgctgctcctgaagcactcgctgaagcagccataagcccataatatttttcagcacccgatagcgaccttccgccccgccttcattggtgatgttggctgccagtgccgtgtcattggtaaatggcgtctggctttcgaagcccatcaatgaccaggtgccagaagagagataagcagcacgtgagccgtttaacggcgaggcgataaccgcgctggcggtatcatggctggcaacggcgaccactggaatctcattaccctgcgggcaaatccagtgacctatgacattacccggatgcgtcgggcgaccaaaccaggctttgttggccccgctccacgccagtagcgactcgtcccagtcgtcgctattgatattgaccagttgcgtggtcgtggcgttggtatattcccagttcatcttgccggtcaggcgataactgaagtaatccggcatcagcagagcgtgagcaatgtgtggaataagttcaggttgttgctccgtcagcgcacgcaactgataaagcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttcaaggctatccacatcccaggtgacatagccgttctgactatgcagcccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgcgaccttctcgttactgacaggaaaatgggccattggcaaccagggaaagatgaacgtgatgatgttcacaatttgctgaattgtggtgatgtgatgctcaccgcatttcctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtgtttaatgggcagccctataccatcaccggtggcacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagctggatgggcagtatccgtctcactggcgcgttaaccacagcgtattgcagcaggtgcgacagctggttgcacagatggaacagcaggaaggggaaaatgatttaccctcgaccgccagtcgcgagatcttgtttatgcaattactgctcttgctgcgtaaaagcagtttgcaggagaacctggaaaacagcgcatcacgtctcaacttgcttctggcctggctggaggaccattttgccgatgaggtgaattgggatgccgtggcggatcaattttctctttcactgcgtacgctacatcggcagcttaagcagcaaacgggactgacgcctcagcgatacctgaaccgcctgcgactgatgaaagcccgacatctgctacgccacagcgaggccagcgttactgacatcgcctatcgctgtggattcagcgacagtaaccacttttcgacgctttttcgccgagagtttaactggtcaccgcgtgatattcgccagggacgggatggctttctgcaataacgcgaatcttctcaacgtatttgtacgccatattgcgaataatcaacttcgttctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtgattgtctggcgcggtaatggcctgcatgtactcaacgatcgcccttatcgcattacccgtggcgatctcttttacattcatgctgacgataaacactcctacgcttccgttaacgatctggttttgcagaatattatttattgcccggagcgtctgaagctgaatcttgactggcagggggcgattccgggatttaacgccagcgcagggcaaccacactggcgcttaggtagcatggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggctagcctgaaaagtccctttgcgctggataaattttgtgatgaggcatcgtgcagtgagcgcgttttgcgtcagcaatttcgccagcagactggaatgaccatcaatcaatatctgcgacaggtcagagtgtgtcatgcgcaatatcttctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcgacaataatcaccacacaaccgaggctcaacaccgttaccggacggcgtcctgcattgttccactctttcagcaccagcccgacgataccgccgcacaatacatagaaactcatatgcagcatccaactgatgtagtcatactgcgccggaatgcgggcgtggccccaggcatagaaaaagaattgcagataccacatcaacccgcccagtgtcgagagtaacacattgtgaatgatcagcgattttgccagcgagaagtcggcttttagcgacaaatccttcacttttgccagacgaataaaacagaaaccgaggttaatgatcgcgccgccgcccatgatgacaacatagcttggcagagcgacatacagtggatcgacgccaagtgcggcagcggcttcatgcatcggttttgcggcgttcatcgcaaaggacatcccggcagagaaaatgccgcacatcaccgccagcaccagcccttttttcagattgaactcttcggctttaatgcccatcttgcgctctttcaactgcccggcgcgagttacaatccctacgccaatcagcgccaccagaacgccgagcaacgtcatgcgtccgccttcggtgctaatcaacacatcgaaattgccgttgataattggcgtcatcagcgtaccgacaatcaacgtaatgccaatggcgatgccaattcccatcgacatgccgagataacgcatggtcaggccgtagttgatattaccgatcccccacatagcgccgaacagaaaaacaggcagtcgcgtagagagactaaacgagctgtaatacgcccagaaattcggtagtaacagggcgctgatggcccacggcagaataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcatttttcgtcgcgtcacatctccgacgagatgagtgtaaaaatcgtgctgtcgattaacctttcgcctgttgccgccgttgtcgatttactggcaatcacggcattaagtgggtgatttgcttcacatctcgggcattttcctgcaaaaccatacccttacgaaaagtacggcattgataatcattttcaatatcatttaattaactataatgaaccaactgcttacgcggcattaacaatcggccgcccgacaatactggagatgaatatgagctataccctgccatccctgccgtatgcttacgatgccctggaaccgcacttcgataagcagaccatggaaatccaccacaccaaacaccatcagacctacgtaaacaacgccaacgcggcgctggaaagcctgccagaatttgccaacctgccggttgaagagctgatcaccaaactggaccagctgccagcagacaagaaaaccgtactgcgcaacaacgctggcggtcacgctaaccacagcctgttctggaaaggtctgaaaaaaggcaccaccctgcagggtgacctgaaagcggctatcgaacgtgacttcggctccgttgataacttcaaagcagaatttgaaaaagcggcagcttcccgctttggttccggctgggcatggctggtgctgaaaggcgataaactggcggtggtttctactgctaaccaggattctccgctgatgggtgaagctatttctggcgcttccggcttcccgattatgggcctggatgtgtgggaacatgcttactacctgaaattccagaaccgccgtccggactacattaaagagttctggaacgtggtgaactgggacgaagcagcggcacgttttgcggcgaaaaaataatcatttgccgcctgctgcaatgaggcgtataggccgcatatcagcttaaaaaatgaaccatcgccaacggcggtggtttttttgtgatcaatttcaaaataaaaacaatgatccgataaaaataaaacagcgtttcaattgatgtggttttgatcacttttattgattaaatgaatgtctatcttcgtttccatcaacactgatgctccattgaggaattacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtactgcgtaaatccggtacgctggtggtaactaaaattgccgtcgcgtgggtggttgcggcaattgcctcgcgtattattccggaacatggtgttgaagttggattctttgccggactttcaacgctggcgctggtggcggcgatggatatgaccaatggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattaccgttcctggtgggctttgccctggggaaccttgaccctgaattgcgagaatttttcagcaaagcggtgcaaacgctgattccattctttgccttcgcgctgggcaataccattgatttgactgtgattgcccagactggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgcagaaatggtgcctgcgtttaaaccgatggctccggcagcaacttcgctggtagcgacggcggtcattgtgacttcgattctggtgccaattcttacctctatctggtcacgtaaagtcaaagccagagcagcgaaaatcgaaattttaggtacggtgaaataaacctgcttccttaatccccacagccggatgaactaacgttcgtccggtttgctattgagttcctgcctggatacttaccgcgaaaacagcacgcctgacataaaataaatatggtctaatggggaaatttctcgtggagagggaacagatgcgatatccggttgatgtatacacaggcaagattcaggcttatcccgaaggcaaacccagcgcaattgctaaaatccaggttgatggtgagttgatgctgacggagctggggctggaaggtgacgagcaggcggagaaaaaggttcacggcgggccagacagagcgctgtgtcattatcctcgtgagcattatctctactgggcgcgggaatttccggaacaggcggagttgtttgttgcgcctgcgtttggtgaaaacctctcaaccgacggcctgacggaaagtaatgtttatatgggcgatattttccgctggggagaggcattaattcaggtcagccagccgcgctcgccttgctataaactcaattaccattttgatatcagcgatatagcgcagttgatgcaaaacacaggtaaggtggggtggttgtatagcgtgatagcgccagggaaagtgtctgcggacgcgccgctggagttggtttcccgtgtcagcgatgtgaccgtgcaggaggctgccgccatcgcatggcatatgccgtttgatgacgatcaatatcaccgtttactctccgctgccgggttatcgaaaagctggacgcggacgatgcaaaagcgccgactgagcggcaagatcgaagatttttcccgccggttgtggggaaaataacccccggagtgtaggcctgataagacgctatcagcgtcgcatcaggcatcctgctcaaatgccggatgcggcgtaaacgccttatcctgcctgcaaatgcgaagtttaactccgcttatacagcggcaaccaaatcaccagccgtaaaccgcccagcgggctgtcttctgccttcacccagccacgatgctgctgaatggcggtttcaacaatcgccagccccaaacctgtaccgccagattcacgatcgcgtgcttcatcggtacgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcggattgccgtacagcggccacggcccaggcgggaagttaactgtcaacgacttgcccatttgctcggcttcgaacgccgcgttatccagcacttcactccacaactggttggctttgatggtttcgctaaccagcgcgtttttttgctgattacgtgacatcaccaacagatcgttgatcatgctgtccagacgttgcgcttcggtttcaatacgctccagttccttgctttcaccgctacgacggcgcagtaacgccgtacccagttgcagacgcgtcagcggggtgcgcagctcgtgagagatatcagaaagcagacgctgctgagaggtcatcatgcgctccagcgcggtgaccatctggttaaaactggcacctgcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccaacatggtgacaatcagcagtaatagcgggcggtcaaacagtaagttaatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccaataacaaacgctgtcctggcggtgcccacttatcaatcgcccggaacagacgccgccaccacattaaatcgttgggcggatcgttcgccagctccgcttcgacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcaaggttttaaaccacgggtgaccatctttacgatccggcagtttacgacgcaggttggaaatgtgcatatcaatagcgcggtcgaaaggcgtcaggcgtttgcccaacacttcctggcttaaatgttcacgggaaaccacctgacccagatgctgtgccagcaaatagagcagggtaaactcagtaccggttaactccagcgtttgcccgtcgaagctggcttcctgacggcctggattcagcactaaggcatcaacttccagtgtcggtgaaccgttgtcgttgttttgctgttgctcgctccagtgcgaacggcgcaggatcgcgcgaatacgtgccaccagctcacgatcattaaacggtttcgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacgtcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaattgctcgtcaggttgagatggcaaaagtccgcaaccaaatgtatcgcctgttaacgccggagcagcaagcggttttaaacgagaaacatcaacaacgaatggagcagttgcgtgacgtgacgcaatggcaaaaaagttcatcgttgaagctattgagtagtagcaactcacgttcccagtagtaaaccctgttttccttgccatagacaccatccctgtcttcccccacatgctgtgggggttttttttatcctcaatttgcctgctgcttaatgcattgcagatgatttgcttccgttatactagcgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttattggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctgatatctccaacaccgatgacagatccaggcgtcggggttatcgtgacaattgtggcgctaatttgtacgattatccttgtctcgtttcagcgttgggtggtgcggcggacgcaaagccaggcggtgcgggctgatatgctacattaccagtctgatgttatgatgaacggcgcaattctgctggcgctggggttgtcctggtacggctggcatcgcgccgatgctctgtttgcattgggaatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtaattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaatgatttcggaaaaaggcagattcctttaccctgaaaccgatgacagaagcaaaaatgcctgatgcgcttcgcttatcaggcctacatgaattctgcaatttattgaatttgcaaacttttgtaggccggataaggcgttcgcgccgcatccggcatggacaaagcgcactttgtcagcaatatgaggcggatttcttccgcctttttaatccctcaacatatacccgcaagttatagccaatctttttttattctttaatgtttggttaaccttctggcacgctttgctcatcacaacacaacataagagagtcgggcgatgaacaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggtgataacgtggtgattcgtcagtcacacggtggctcaggtaaacaagcgacgtcggtaatcaacggtattgaagctgatgttgtcacgctggctctggcctatgacgtggacgcaattgcggaacgcgggcggattgataaagagtggatcaaacgtctgccggataactccgcaccgtacacttccaccattgttttcctggtacgtaagggaaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggcaaaagcacaggattttgttcgggcactgtataaaaacgtcgaagttctggattctggcgcgcgtggctccactaacacttttgtcgagcgcggaattggcgatgtactgattgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggtactaaagaggtggcggaagcctacctgaaatatctctactcgccagaaggtcaggaaattgccgcgaaaaactactaccgtccgcgcgacgctgaggtggcgaaaaagtacgaaaatgcgtttccaaagctgaagttattcaccattgatgaagagttcggcggctggacgaaagcgcaaaaagagcattttgctaacggcggtacgttcgatcagatcagcaaacgctgatttccccaggataattatcaaacccggtggtttctcgcgaccgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcggatacattacgtaagattgtccttgaggaatgtttgcccaatcagcagcaaaatcaaaatccttcgccatgtgcggaagtcaaacccaatgccggatacgtggttttaaaagatcttaatggcccactgcaatatctgttgatgccaacgtatcgtattaacggtactgaaagtcctttgttgaccgatccttcaacgccgaacttcttttggttggcttggcaggcgcgtgattttatgagcaaaaaatacggccagccggttcccgatcgcgcggtttctttggcgatcaactcccgcaccgggcgtacgcaaaaccattttcatattcatatctcttgtattcgtcctgatgtgcgcaaacagctggataacaatctggcgaacatcagcagccgctggttgccactgccaggtggtttgcgcgggcatgaatacctggcgcgtcgggtaacggaaagcgaactggtacaacgcagcccatttatgatgctggcagaagaagtacctgaggcgcgggaacatatgggacgctacgggctggcgatggtacggcagagtgataactcatttgtattgctggcgacacaacgaaatctactgacgcttaaccgtgcttcagccgaggaaattcaggatcatcagtgtgagattttgcgttaaggcgaagagttaaggaaagtaagtgccggatatgaaatccggcacctgtcagacttaagcctgtttagccgcttctgcagctttaacgattactgcgaaggcgtcagctttcagagaagcaccaccaaccagcgcgccgtcgatatccggctgagcaaacagttctgcagcgttagacgcgtttacagagccgccgtactgaatgatcacttgttcagcgatgttagcgtcaactttagcgatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcgcaaacttcttcagttttgcccgcttcattttcagcttcggtttcaccgatgcacagaaccggagtcaggccctgctctttcagcaccgcgaattttttcgcgatcagttcgtcagattctttgtggtaagtacgacgttcagagtgaccgatgatgatgtactgtgcgccgatgtctttcagcatagcagcagaggtttcaccggtgaatgcgccggacaggttcaggtccacgttttgcgcacccagcatgatgtggctgccttcagcttcgcgcttcgccatatcgatatacatttccggtggtgcgattgcaaccgcacagccagcaacacctgccagctctttacgcaggttagaaaccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgtgttttggtcattaatggggtgagtgtgcggatcaccgctgccatgtattcctgagctttcgctttcgcggctttttgctctggcccctggatgggtagccaggtcatttgaatgcttttgatttttaaggtaccgcgctccagcgctgtagaagcatacaagttctcattaattttacttgcagcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgcctctgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaagaatctactcgatattcagaccgcggcgttttgccttgtgtgcttgctctggccaacagcggcagtaactgttaagcgcttgcatgatcgcgggcgttccggcgcatgggcatttctgatgattgtggcgtggatgctgctggcgggtaactgggcgattttaccgggtgtctggcaatgggcggtggggcgttttgtcccgacgttgattctggtgatgatgcttatcgatcttggtgcgtttgttggcacacaaggcgaaaataaatatggtaaagatactcaggatgtgaagtataaagccgacaataaatcaagtaattaacctttaatatatctcttactgctatttttttccgggattgttatttccacgatgcaaatgacaatacccggaaaatccttctgaactcttcaccttaagcaatatcaaaaaaaatggtaatccataagatcattacttgtttgttcttcccttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcttttatgaccaaactgaaagagcttgccgccgctacatcctctgcagatgaaggggccagcgtggcctataagattaaggatctggaggggcaagttgagcttgatgcggccttcactttctcatgccaggccgagatgattatttttgagttatcactgcgttcgttagcttgatggagttgctttagaaggagttaaacatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcatcactcatttatcaaccgtttgatgccggcatatcgcgggatgatcaataagatgagtgcggatttgctcatcgtgccgtttatcgataagtaaccgcttaccagtaatgctccgctgtcatatggcccggtcggcgacgtaaatgtttcgtcatctgccgggtctctttcagcaactgttgtgtatcgcgcaccatctgtggattgccgcacagcatcacatggctggtttctttattcatcggcaggccaatcgtgctttccagttccccactttcaattaatgccggtatccgtccggtgagcgaccccgctgccgtttcccgactgaccaccgtctgaatgcgcagttttccttcgtagcgtttttccagttcctgcatcagtggcaaatagcttaagtcggcggcataacgtgcggcgtgcaccaggaccagatttttgaagcgatctaaatctttacctagttgcagaatcgataaataagggccaatcgctgtaccggttgccagcatccatagcgtttcgcagtgcggcacttcatcgagcacaaagaatcctgccgcttcgctaaccacctgcacttcatcgcctggtttcagtgccgccagtcgtgggcttaatttgccatcggggacggtgaccaggtaaaactccagatcgggattatcgggcgagtttacataggagtaggcgcgctggacgcgttcgccgtcgatttcaaggccaagcttggtaaattgcccggcggtaaacggaagcacgggggcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttgcgatccagatagtggatggactgaatgcggcgaatggtgcgtgacttgccgcggatcagcagcgtttcggtagtcgcgatattgcctttgcggctaatgccttccagcagatcgcctttggtaataccggtggcagagaagatgacgttatcgctgcgcgccatatcgcccaggcgcaatactttaccggcttcgatgcccatcgctttgcagcgtgccagctcctgctcgccaatgcgacgattctcttcgttgtcgcctttgacgtcatgacgcgccagcagacgaccgttcatgtcgccatctaatgcgcggatcaccgccgcagaaactacgccttccggcgcgccaccaataccgtacagcacgtcaacttcgctgtctggcatacaggtgagaattgaggccgcaacgtcgccgtccggaatagcaaatacgcgtacgccgagttgctgcatttcagcgataacggcatcgtggcgtggtttagccagaatcgttaccgtcagttcgctcaacggtttgccgagcgccgccgctacattgcgcaggttatccgccagcggcaggttcagatcaatggtgcctttggctcccggcccgacaatcagcttctccatatacatatccggcgcattgaggaagcagcctttatcgcctactgccagcaccgccagcgcgttagcctggcccatcgccgtcatgcgcgtgccttcaatcggatcaacagcaatatctaccgcgtcgccgcgaccagtaccgactttttcaccaatgtagagcatcggtgcttcgtcgatttcaccttcaccaatgacgatggtgccgtcaatgttgacctggttgagcataatacgcatggcgtttaccgccgcgccgtccgcggtgtttttatcgccgcgtcctaaccatttgtagccagccagcgccgctgattcggtgacgcgggaaaattcgatggcaagttctcgtctcatagcaaactctaagcagtaaggaatggcgcgaagtgtagcacaggggaagggagggattattgatgtgtgcggggttgcccccgcacgtttcgggactaccggatgcggcataaacgcttcattcggcatttacattattcgtcgtgttcttcccacgccatcgcgcgtttaaccgcttttttccagcctgcgtaacggtaattacgctcagtggtttcgatgcctggacggaactcgcgctcaatcaccgctttctcttgcagctcgtcgaggttctgccagaagccaaccgccaggcctgcgagataggccgcacccaatgcggtgacttcgcgcacttccgggcgctcaacgcgggtgccgagaatatcggactggaactgcatcaggaaattgtttgctactgcgccaccatccacgcgcagggcgtgcagacggataccagagtcggcctgcatcgcttccagcacgtcacgcgtctgataagcaatagactccagcgtcgcgcgtataatgtggttagcgttcaccccacgagtcagaccgaaaatcgccccgcgcgcatacgggtcccagtacggcgcacccagcccggtaaatgccggaaccacatacacaccattggtgttttgcactttggtggcgaaatattcggaatcgtaggcgtcgttaatcaacttcatttcatcgcgcagccactgaatggatgcgcctgccataaacaccgcaccttccaacgcatagttcacttcgccagtcgggccgcaggcgatggtggtcagcaggccgttttctgatttcaccgctttctcgccagtgttcatcagcataaagcagccagtgccataggtgttcttcgccatcccttctttcacgcacaactgaccaaacagcgcggcctgctggtcaccggcgatcccggagattggaatacgcgtgccgcctttgccgccaatgttagtctgaccgtatacttcggaagaacgacgcacttctggcagcatctcgcgcggaatatccagcacttccagcattttgtcgtcccagtccagggtatggatgttgaacaacatggtacgagaggcgttggtgtaatcggtcacatggacacggccctgagtcattttccagataagccacgtatcaaccgtaccaaacagcaattcaccacgacgtgcacgctcgcgagagccttccacatggtcgaggatccacttcactttggtgccagaaaagtacgggtcaatcaccagaccggtattgctgcggatataatcttctaaaccgtcacgttttaaatgctcgcagatttctgcggtacgacggcactgccagacaatggcgttatagataggcttgccggtttctttttcccagacaatagtggtttcacgctggttcgtaataccgatagctgcaatttgatcggaactgatatcggctttcgccagcacttctaccagcgtggagctttgggtggcccagatttccattgggtcgtgttctacccaacctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtttccttttcttccacaacacagatatcgcaaggcaaatggcgaccaatcagtttgcggtaggcaaatgcacctacaatcgcgccaacgatagggccgaaaagcggcaccaggaagtaaggaatgtctctgccgccggtaaaggcgacattgccccagcccgccagccaggcaaagactttcggaccgaagtcacgcgctgggttcatggcaaaacctgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtaaactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgaccaaaagacgcaccagcgacttttagtgctgcaacgcaacccacaccgaagaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaggcatgctgtaaacttatcgttaacgagcaaaaacgagaaatatcgaacttaaaatgtgtgtgcctcgtcataaaatgagcgttatcgcgccatttattccatctgattgtacatgatgcatgtttgttagatcattcgcgcaacaaatttattaacattttcgattgatgtggattatgtcaccaggagaaggatgaaaagtgtggcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctgcaggccctgctgggtcgcatggaagaggtctgattacgcttcatcttccgcgtaatttctttactgtgtaggccaacaggtaacgcagaaaaaaggcaccttgcggtgcctttcttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaaccaccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcccttgacagtacgttccagcattggtcgcatcgccaccgggtccatttcccgcatcacataacgggcttgcttcaccagtaatggtgccgccagcaggaacagccagccccacaggctatgcagcgaaaagagattaaacagcgccagacacaccagcgagcccatcagcaggcaggcatgataacgacgcgcgttcacttcacctaagcgcaccaccagcgtgtttttgccattttcgcggtcgctattgatatcacgcaggttattaatattcagtactgccgttgccagcaggccgcatgcggtcgccggaaggatcagtgccggaatcaatgtatgagcctgtaaataccagctccccatgacactcaaccagccaaagaaaaccagtacggaaatatcacccagaccgatataaccataaggacgattgcccacggtgtaggtgatagcggcaatgatcgacaacccgccaagaatcaggaaaccgacaaaatcggccagcgtatggcatgccactgcaaccagtgccagcccggagagacagatgagcacgacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaattagtgccagcagggcgaccagcggatcgaagtgaccttgccaccatgccagcgctgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatattttgaccgcttaaatcgctggcgtcgtaggaaatctcttccattaaacgctccagaacagtgtgtaaacgacgagcaccgatgttttcggtagattcgttcacctgccatgccgcttccgcgatgcgtttaataccggagtcggtaaactcgatatttacgccttcagtcgccatcagtgctttgtactgcacggtgatagaggcattcggctcggtcagaatacgctcgaagtcgctggtggtcagcgcctgcagttcaacgcggattggcagacgaccttgcagttccgggatcaggtcagacggtttcgcaatctggaacgcgccagaagcgataaacagaatgtggtcagttttgaccatcccgtgtttggtggaaacggtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcgtcttgcttcagctcttccgggttcaccagtttcgccgcttcttcttcaatcagcagcttcatggcgtctttgattttcagcttacgcgctttttgcttctggccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagcaggtgggatcagcacgtcgagaatacgttcttctgccagttcttcagcgcgataacggtttttctcgatagcctggacgcgtaccattttcacggcggcatcggtcagatcgcgaataatagaatccacttccttaccgacgtagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacagaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtgttttctaacagcgcgcgcgccgcagcctgggcgtaagggccgccggagccgatagcaataagatcgttttctggctgcaccacgtcaccgttaccggtgatgataagcgatgcagtttcatccgcgactgccagcagtgcttcaagtttgcgcagcatgcgatcggtacgccagtcttttgccagctcaacggcggctttgaccagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggttacgaatacagagtacaaaccccgtacaaaagtacggggcataatgcaattatagatgggggggattttgagggtttcaacccccggcggcgagccgaatgcagtttgtatgacccgccatcttcaaccgattgagggtgctgtctgcgttctctttgcctttcaccgggccaatgaccacacgattccagccattgttggtggtgattttcgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaactggcgcagcttgctgcggcttcgactgcgcagtcgtgtgcgcaggagtttgcagcagatcctggtacggctgctgagaagaagccggtttagactggcgcggttgcgcctgtaccggtgcggcttgcgacgtacgcgtctgctgctgccagctttgttcagtcgtacgcgactgctgagccaggcgttgctgttccgctaattgctgcgcctgacgttggcgctgtagcgtttgctgacgctgttccggcgtctgttcattccacggaacttcaaccagctgcgttggctgctggcgcatatcagcctgcatttgttcaagaagctgacgttgttctggtgtcagttgctccggcgttttcacttcaccaccggcagaaggttctgtgggcgcacgcactcccggctggcgactttccagctctttaatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcagctgctgcatcgctttgcttccggcttcgaaggtgaagtcgccacgggcgatgtattgcggatcaaccataatgccgcagcgacgcagcgcctgaacatagccttgcaggcggtagtgacacagcggcatctcttcgggaccggctatacagccaatccgtttatgcccttgctcatataaataatttactgcatcaaatgcggcggtcagattgtcgatatgaactgtaggcagctccagctccggtgcaaattcgttcgccatcaccatcggcggcagattacgctgttcctcaatgctggcatcaaacggcagccttgaacccagcaacaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaagggatcgcagatatccgggacaatcaccagaatggtgcgggattcattacgcttgacgttgcgccccataggctgcggtaaataacccacttcccgggccgctttttcaacccgattacgggtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcaacatccagcacccatttcaccttacgggaatccggtattgtattgatgagcgccagcgtaccgttaatgatgtgttgcaagcgcacgcgggaagggtgctgcaacaatatctgccagcgccagcgaccgccacgtttaggtgccagagccggaaccggaccgagaacccacagtttctcgtctgccagtgggctggagaggatcagattacgcagttgttgcaggaacaatggcgcgtgctgattgttatgatcttccgcacgcacaatcacatggctggtccacggcggtagctgcatcattcgccgctcagccagcgcctgttcggcaaaggcgtcgtagcctttatagagcaacgtttgcaacagaggatgttccggatggtgcgtttgcagcaccacttcgccctgtttacccgcacgcccggcacgaccggcgacctgggtgtaaagctgagcgaaacgctctgccgagcgaaaatcggcagaaaacagcgcgccgtccacgtccagtaatgcaaccagcgtcacatccgggaaatggtgacctttcgccagcatttgtgtaccaatcaaaatccgcgcgccgccgcgatgtacttctgccagttgctgttccagcgcccctttgcggctggtggtatcgcggtcgatacgagaaatgggcacgccggggaacaacggcgcgagcgtctgttcaagctgttcggtgcccagccccacggggaccaggtgcgtggaaccgcaggaagggcactggcgcggcaccggacgctgactgtcacagtggtggcagcgcagatggtgctgcgcctgatgcagcgtgtagtagtgatcgcaacgtgggcattcggcaatccagccacagtcgtggcacagcagtgcaggcgcaaagccacggcggttaagaaagagaatgacctggttatcagcctgtaaatgctggcgcatacgagtgattaacgccggagccagacctgcctgcaccttctgaccttttaaatccagcacatgttgaattgccggacgcgcattccctgcccgacgggtcaggcgcagcaggcggtattttttctgctggacgttgcataacgtttccagcgcgggcgttgcggagccaagaataatcgggatttgctcgctgtgcgcacgatacaccgccaggtcgcgggcatgatagcgccagccttcctgctgcttgtaggagctgtcgtgctcttcatcaatgacaatcacgccgagatttttaaacggcgtaaacagcgcggagcgggtgccgatcacaatcgccgcctcaccatttttcgctttcagccacgccgaaagacgctcgctgtcgttcaggccggaatgcagaacttccacgggggcattaaaacgttcacgaaaacgggcgatagtttgcggtgtcaggccgatttccggcaccatcaccagcgcctgtttgccctgagcgagcacgttttccagtacgctgagataaacctccgttttaccggaaccggtaacgcccgccagcagccaggcagaaaaagtatctgccgcgctatgaattgcgccaacggcggtggcctgttcggtattcaatcgcaaccgctcaccagaaacggcatagttcgttcgccagtcgctaaactctggtgtttcacttgctaaatcacacagaccttttttgcgtagcgcctgcaacgcggcatcattaaattcgagcgtggcgacctggtcgcgccagattttgccttgccgtaacgccgccagcgcctgttgttgcttgggggagcgtttcaggctgttcagatccaccgcctggccttgttcagtggcaaaccagtaccacatcggcgcgttcgccgcaggccgcccctggcgtagtaaaatcggcaaggcatgaaacagcacatcgccaatcggatgatgatagtaatctgccgcccatagcagcaatcgccagacggagtgagtaaacaccggctcactatccagcacttcgactaccgcttttagctcattgagcggcagttcgctggcatcgctaactgataccacaatcccgatgcgctcctgctgtttgccaaacggcacgcgcacgcgacacccagctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatacgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataagaccggatttccgaaaaaagcgccgcacggcgctttttttgtgcctgaattttggtcgtattaccacgaaaacagcggccattctttggcgaccgtggtgagttgtggcgcatcgaaaacggcttgtggcgagaccaccgtttcctcaagcggaatattcttgccgtaacgttctttgagctttgcctgaacttgtgggctgctcaggtcgaactctttcaacttctgctgctcgcccacgcgcattcccagcgcgttctggtaaaccttccacaccacttccgaacagtactggcgatcgtcgctccatgagaagctgaaatcatacggtttaccgagataacgttttgccgtttgcgccagtttttgctgttgttcaacactcagtccgccttcaacgcggcgaacaacgtatttgcccttttcaccatgggcgatccactgcttgagcggggtgtatttcaccgggccgactgcttcaaaaacgtagggctttttgttgcgtatcaccagcataccggtgtggctataatcggtatgggtcgccagttggatcgctttactttgcgatgagcgagagatctgaaagatgatgtcgccggtttgtggctgccaggcaaaggcaggtacagaaaccagcaggctgaggatcagcagcctgtttttcatagttaaacgtccatgtataaaaagcggtgggtcgcagacaacgtgctcgttgtttatgccggatgcggcgtgaacgccttatccggcctacaagttcgtgcaaattcaataaattgcaatatgacgtaggcctgataagcgtagcgcatcaggcgattccactccgcgccgctcttttttgctttagtattcccacgtctccgggttaatccccatctcacgcatgatctcttttgccgcttccgggatttcgtcgctgcgctctttacgcagatcggcatcatccggcaaaggttgcccggtaaaggcatgcagaaacgcttcgcacagcagctcgctgttggtagcgtgacgcaggttgttcacctgacgacgcgtgcgttcatcggtgaggatttttaacaccttaagaggaatggaaaccgtaatctttttgacttgttcactcttcttgccgtgctcagcgtatgggctgatatattcgccgctccattcagccatgagatacttaatcctcttcgtcaataaattgagaccagaccacacagttgatgtgggtactgaccgtaaacccgcatagtttaccgtacaggcgttaccgtgacatcgtgtaatgcacctgtcggcgtgataatgcatataattttaacggctatttgggatttgctcaatctatacgcaaagaagtttagatgtccagatgtattgacgtccattaacacaatgtttactctggtgcctgacatttcaccgacaaagcccagggaacttcatcacatgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgctggtgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgcaacgcgcaggcgattgtgaaatacctgcaaacccagccgttggtgaaaaaactgtatcacccgtcgttgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaatttcagaaatttaataatgcccggtactcatgttttcgggtttatggtttctaatgaaatatattgaattatcataggattaggccggattaagcgtttacgacgaatccggcaagaagcaataagtacatggttagtttatatttgcagtccggtttgctttgcataccggattttctttttcttaccatcctgaagttttttcatcttccctgatttttcctcaccatcattggtcatttttcggttgacgcccttcggcttttccttcatctttacatctggacgtctaaacggatagatgtgcacaacacaacatataactacaagcgattgatgaggtaaggtatgagcttttttcacgccagccagcgggatgccctgaatcagagcctggcagaagtccaggggcagattaacgtttcgttcgagtttttcccgccgcgtaccagtgaaatggagcagaccctgtggaactccatcgatcgccttagcagcctgaaaccgaagtttgtatcggtgacctatggcgcgaactccggcgagcgcgaccgtacgcacagcattattaaaggcattaaagatcgcactggtctggaagcggcaccgcatcttacttgcattgatgcgacgcccgacgagctgcgcaccattgcacgcgactactggaataacggtattcgtcatatcgtggcgctgcgtggcgatctgccgccgggaagtggtaagccagaaatgtatgcttctgacctggtgacgctgttaaaagaagtggcagatttcgatatctccgtggcggcgtatccggaagttcacccggaagcaaaaagcgctcaggcggatttgcttaatctgaaacgcaaagtggatgccggagccaaccgcgcgattactcagttcttcttcgatgtcgaaagctacctgcgttttcgtgaccgctgtgtatcggcgggcattgatgtggaaattattccgggaattttgccggtatctaactttaaacaggcgaagaaatttgccgatatgaccaacgtgcgtattccggcgtggatggcgcaaatgttcgacggtctggatgatgatgccgaaacccgcaaactggttggcgcgaatattgccatggatatggtgaagattttaagccgtgaaggagtgaaagatttccacttctatacgcttaaccgtgctgaaatgagttacgcgatttgccatacgctgggggttcgacctggtttataaatagtgtggcttttgtgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacaccacagccactggcaaatgcccgttccatcagggcggtcacgaccagagtgcgggggcgggcacaaccactcgcgactggtggccaaatcaacttcgtgttgacctgttaaaccaacattctaatcgttctaacccactgggtgaggactttgactaccgcaaagaattcagcaaattagattactacggcctgaaaaaagatctgaaagccctgttgacagaatctcaaccgtggtggccagccgactggggcagttacgccggtctgtttattcgtatggcctggcacggcgcggggacttaccgttcaatcgatggacgcggtggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctagaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggtctgatttacgttaacccggaaggcccggatcacagcggcgaaccgctttctgcggcagcagctatccgcgcgaccttcggcaacatgggcatgaacgacgaagaaaccgtggcgctgattgcgggtggtcatacgctgggtaaaacccacggtgccggtccgacatcaaatgtaggtcctgatccagaagctgcaccgattgaagaacaaggtttaggttgggcgagcacttacggcagcggcgttggcgcagatgccattacctctggtctggaagtagtctggacccagacgccgacccagtggagcaactatttcttcgagaacctgttcaagtatgagtgggtacagacccgcagcccggctggcgcaatccagttcgaagcggtagacgcaccggaaattatcccggatccgtttgatccgtcgaagaaacgtaaaccgacaatgctggtgaccgacctgacgctgcgttttgatcctgagttcgagaagatctctcgtcgtttcctcaacgatccgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtgtggttggtgttgagaaagccgcaagcgccgcaggtttgagcattcatgtaccgtttgcgccgggtcgcgttgatgcgcgtcaggatcagactgacattgagatgtttgagctgctggagccaattgctgacggtttccgtaactatcgcgctcgtctggacgtttccaccaccgagtcactgctgatcgacaaagcacagcaactgacgctgaccgcgccggaaatgactgcgctggtgggcggcatgcgtgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgtgaaaccggcgaagtgaaatttacggccagccgtgcggatctggtgtttggttctaactccgtcctgcgtgcggtggcggaagtttacgccagtagcgatgcccacgagaagtttgttaaagacttcgtggcggcatgggtgaaagtgatgaacctcgaccgtttcgacctgctgtaatctgaccccgttcagcggctgcttgctggcagtcgctgaacgttctttaccagcgtatagtgggcgaacgaaaactacacactggatctctcatgtctgccgcaggaaagagcaacccactggcaatcagtggcctggttgtgctcacacttatctggagttatagctggattttcatgaagcaagtcaccagttacatcggtgccttcgactttaccgccttacgctgcattttcggcgctctcgttttattcatcgtccttttattacgtggtcgcggaatgcgcccgacaccgtttaaatacaccttagccattgccctgttacaaacctgcgggatggttggtctggcgcagtgggcgttggtcagcggaggtgcggggaaggtggcgatcctgagctataccatgccgttctgggtggtgattttcgccgcgttgtttctcggtgaacgcctgcgacgtgggcaatatttcgcgattctgattgccgctttcggcttatttttggtgttgcagccgtggcaactcgatttctcttcgatgaaaagtgccatgctggcaatcctctccggcgtcagttggggggcgagcgcgattgttgctaaacgtctgtatgcccgtcatccgcgcgtggatttattgtcgttaacatcctggcagatgctgtatgcggcgctggtgatgagtgtggtcgctttactggtgccgcaacgtgaaattgactggcagcccaccgtgttctgggcgctggcctacagtgcgattctggcgacggcactggcgtggagcttatggttgtttgtattgaaaaacttgcctgccagtattgccagcttaagcacactggccgttcccgtttgcggcgtactcttttcctggtggctgctcggcgagaatccgggggccgttgaaggtagcggtattgtgctgattgtgctggcactggcgctggtgagccgtaagaaaaaagaagccgtcagtgtaaaaaggatctgaattttttcttcatgtggggcgatctcttatttaacaaaataacgataatgccccaccatccgccagttaaacagcacatcttcttcctgcgcgcctgcgccaatgttatgtatcaccagcggcgtaccgtcgcgggcgaagccatctgaaaccaccccaatatgtgccagcccgttatccagtcgccaggagacaatatcgcccgcttgatagtcactggggttcttgctggtggggcgtgttttatcatggcggctaaaccaggtttccagattaggcacccgacggtgatcgatgttgctgtccgggcgctttaacttccatttttgcgggtactcagcaaaattcttcgccatatcttcgtgaaccagtttctgcaaatcgaccttctggctgcgcaatgcgcggatcaccacatcggaacatacaccgcgttcttgcggaacatcaccgccaggataagtaagctgcacatacgccggatcgtaaaatagcgtgctgccaatttgctgtctggcaccgtctgcgatggcaaggttggtattggcctggatttgtaccacggttggtggaacggcgggagattttaaggagtggctggtaaatgccgttagcaggctgagcagcgccagtgaagctttcatctggttcgtccgtgaaaataagagtcacagattcgaccttccgggctaacgattgttctgtagagaaaatgtccagaagcggataaaaaattcctgaacaacgtgggagtttcagattactggcacagagtgccggatgcggagtgaacgccttatccggcctacaaaagcacgcaaattcaatatattgcagagattgcgtaggcctgataagcgtagcgcatcaggcaattttgcgttcaaactcccggacaagccgggagtttggagtaggttattcccactcttgcaggaaacgctgaccgtactggtcggctaccagcagagcggcgtaaacctgatctggcgtcgcgccgccaggcatgttgtgaatggtttcaccttctgcacatgccgcttctgccacaattcgcattttcgccgggacatcttctttaatatccagttgagcgagagttattggcaaacctaccgcatggctaagggcagctacggtttcgatttcctccaccggcgcattttccagaaccagctgcgtcagcgtaccgaatgccactttttcaccgtgataatagtgatgcgcgtccgggatagcggtcaggccgttatgcactgcgtgcgccgcagccagaccaccactttcaaaaccaacaccgctcaaataggtgttcgcttcaatcacgcgctccagcgccggagtcactacatgctgttcggcagcaagcatcgctttttcgccttcttccagcagggtgttgtagcacagttcagccagtgccagcgcagcctgggtgcacttgccgcccgccatggtggtcgcgccgctacgagagcaggcacgcgcttcaaaccaggttgccagcgcatcgccgatacccgccgctaacagacgtgcaggtgcgccagcgacgattttggtgtcgacaatgaccatattcgggttatttggcaacagcagatagcggtcaaactcaccctcatcggtgtagataacagacaatgcgctgcacggtgcatcggtagaggcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttctgccagcggcttcaggtattcgcccagacgattaatcacatcagcgccctggatgtatttacccggtgattgaataatgcggtccataattgctcctttagagatgagtagtgccaaatgcggcattccagtcgtgttcgaacttctctatagctgactctaccgcaggggtgttgagcatttgttgcgctacatctaagggcagggtgatggattcacatcctgccagtaaacagtccagcgcctgacgcggcgttttaaagctggctgccagcaccatgctttctggcgcgtgcatttctaacagcgtttgcagctcctgaaccgtacgaatgccgtctccgccctgggcatctacgcggttaacatacggagcaacgtattttgcccctgccagtgcggctaataacccttgtgcggcgctatatacagcagtgccaagtgtagtaataccctcttttttcagtattttaattgctgccagaccttcggaagtcaccgggattttcaccacaatacccggaatagcgtcgcgcaggcgcttcgcttcttccaccatcccctgcgcgtcgcggctcatggtctgagcaaacagaatgccctcatcaccaatcgctttttgcagacgcggcagcacttcccatatggactccttgctggcagcgataatgctcgggttagttgtcaccccggcaatggggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcgttacggaattcttcgtgcatgatgcggcgagcgaggcgcgagaaaatgcgcatatgctgatcgcccgcagcgtgtttgttcagggttaacataatgatgaattgcgcttcatcatcgccccagcgcaccggcgcttgcagacgcgccacgctgatggtggattgctcaatgtgttctgatttgctgtgtggaatggcaaaactaaagcccagaccggtagagaaaacggcctcgcgcgcccacaagtcggcttccagtttacgcggatagcggcagcggcccgccagcagcaggttatcggtcatgcctttgagcacttcttctttgctgcgccagtcgctttccagtgtgatgcactcggcggtgaccagcggtgcgtcttgttgggtcatgcggaattgcgccagcaggtgttctacttccagcgaagtacggcaggccattgcctggttgagcaacttgcggcactcacggctatcaagttgcgccatccgagctttcgccgccggaattgatggtgcgctcatgctgagttcatccagccctaagccgaccagcaacggcagcacggaacctttcgctcccagctcaccgcacagaccaatccatttgccctggcgatgcaccgcttgcacggcgtaatcgagcgcccgcaagaatgccggattcaggctgttgtagtgacgagtaaccttagcgttatcgcgatccaccgccagcagatactgcgtcaggtcattactaccaatactaaagaaatcaatctcttcgcagcattgatcgatgatgaacatcaccgacggcacttccagcatgatgccgagctggattttctcatcaaacggaatgtgttcgttacgtagttgctgtttggcttccgccagtttttctttcacccataagatctcttccattgaggagatcatcgggatcatgattttcaggctgccgtgagcggaggcgcggaggatcgaccgtagctgcgtggtaaacaacgacgcgtactcttcataaatacgcacggcgcgataaccgaggaacgggtttgcctctgcgggaatgttcagataatcaacgggtttgtcgccgccaatgtccatagtgcgcacaataatgctgcgtccgttggcggattccagcgcctgacaaaaaatgttgtacaactcgctttcgcccggtgcgctggtgcgatccatatagagcatttcagtgcggaacaaaccaacgccttccgcaccattgccgaatgcggcctgcgcttccacggagtgagcgatgttagcggcaatttcaatgcggataccgtcagcggtacgggcttgttgggtcagccagacacgctgttgctcacgcagggcgtcctgtacgcgggcttcttgctgataataacgagctacggcttcccctggctcaaccacaatcgccccggcgttgccgtcgatataaatcgtttgttgctgccacggagtaagggcatcaatatccacaccaaccagcgttggaatgttgaacgaacgggcaaggatcaccgtatgtgaggtggtgccgccgcttttgagcaacaatcctttgaggtgatttttatccagttcgaggaactggctgggggtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggaaaactcttcgcaaaagtgattcgcgctggcaacaattgcttcggcgcagcttaatccggcgctgacgcctgccagtaaatgttcgcgcagggaagtatcgccagccagggatcggtgagcttccagaatcgcgctggtagcaccgtcgctatccagcagacgaaactcaatgtttttcagtaccagcgtcaggccgttttccagtgcggattgctcggcgtcaacgcctttggctgcgggaagattacccagcgcattgagatctaaagaagagatcggcgtcagaatgccgcctgcactaccgctgcacacggtgcgggcgcggataatttgcggattcagattggtcagtgaaaccggcagtggttccagttcgtcagatttaacttccgccagcggcgcatcgcagtgggggaattcatcgcgcagccattggcttaaacgctggtgcgcttcctgttcgtcggccccggaaatcagtaactggcagttatcgcccgccagcgtatcggtgccaatcagcgcaagggcgcttttggcgttgcccttgcggtcagtgcgcaggttatgccactcaatttgtgatgaaaaagtattacacagcgtttcaacgtggcttgccggacgcgcatgtacgccgttaggtagctcacaaataaattccacaatcagggccattgcctctctcccggtacggttttctgtttacaggataagagcgcacggcaacggcctgccatgtgacaaatctgccaaaagctggacaaatgtaatgtaaccgtcaatttgcgacgcgtctcacaagacgctgttttgcggcatgcttccggtttatcgcaagttatgaggcggatcgcatttttgtactgatattacaaaagtccagtaaatggcctttttatccactgtttgctccgcctgcgattgcctattgtttcctccatcaaaaatatggacatgggctttcgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccaaatctgaaaaaactgtttgatatcggcgttgcgggcttgacgctgatggtgcctttcctcgcagcgtacatcggttattccattgcagagcgttctgcgctggctccgtgcgctatcggtgcctgggttggtaacagctttggtgcgggcttctttggtgcactgatcgccgggattatcggcggcatcgtggtgcattacctgaagaaaattccggtgcataaagttctgcgctcggtgatgcctatcttcattattcctatcgtcggcacactgattaccgcaggcatcatgatgtggggcttgggcgagcctgtaggggcgttgaccaacagcctgactcagtggcttcaggggatgcagcagggcagcattgttatgctggcggtgatcatgggtctgatgctggcgttcgatatgggcggtccggttaacaaagtggcctatgccttcatgctgatttgcgttgctcagggtgtttataccgtggtggccatcgctgccgtgggtatttgtatcccgccgctggggatggggctggcgacgctgattggtcgtaaaaatttctccgcagaagagcgcgaaaccggcaaagcggcactggtgatgggctgtgttggcgttactgaaggggcgattcctttcgccgctgccgatccgctgcgtgtcattccttccatcatggtcggttcagtttgtggtgcagtaactgcggcgctggtcggtgcgcagtgctatgcaggctggggtggtctgattgtgctgccggtggttgaaggcaagctgggttatatcgcagcagtggctgtcggagcagtggtgacggctgtttgtgtgaacgtgctgaaaagtctggcgcgtaaaaatgggtcttcgactgatgaaaaagaagacgacctggatttggattttgaaattaattaattgaggaacgagccatgacgaaaattattgcagtaaccgcatgtccttcaggtgttgcccatacctatatggcagcagaggcgctggaaagtgccgcgaaagcgaaaggctgggaagtgaaagtagaaacccaggggtcaattggtctggaaaatgaactgactgcggaagatgtggcgagcgctgatatggtgattctgaccaaagatatcggcatcaagtttgaagagcgttttgctggcaagaccatcgtgcgcgtcaacatcagcgatgcagtaaaacgtgctgacgccattatgagcaaaattgaagctcacctggcgcaaaccgcttaagttcttctcccgctcgcaagggcgggttcgctttcccacaggagttcctcatgacgaatcgtatctctcgcctcaaaactgcactgtttgccaatacccgtgaaatctcgctggagcgggcgctgctttataccgccagccatcggcaaaccgaaggcgaaccggtgatattgcgccgggcgaaagcaacagcgtatatccttgaacatgttgaaatttcgattcgtgatgaagaactgattgccggtaaccgcaccgtaaaaccgcgcgccgggattatgtcgccggaaatggacccttactggctgctgaaagagctggatcaattcccgacgcgtccgcaggaccgctttgctatcagcgaagaagataaacgtatctaccgtgaagagttgttcccgtactgggaaaaacgttcgatgaaagatttcatcaacgggcagatgacagatgaagtaaaagccgcgaccaacacgcagattttcagcatcaaccagacggataaaggccaggggcacattattattgattacccacgcctgttgaatcacgggctgggtgagctggtggcacagatgcagcaacattgtcagcaacagccggagaatcacttttatcaggccgcgttgttactgctggaagcctcgcagaaacacattttgcgttacgccgaactggcggaaacgatggcggcaaactgcacagatgcccagcgtcgcgaagagctgctgactattgcagagatctcccgccataacgcgcaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatgcggcgttcctgaaagaactgctcgaatctttatgggtgaaatgcaacgacatcgtgctgttgcgctccaccagtagcgcgcgttatttcgccggtttcccgaccggctataccgcactgctcggcgggttaaccgagaacggacgtagcgcggtgaacgtgctttcgttcctttgccttgacgcctatcaaagcgtgcaattaccgcaaccgaacctcggcgtgcgcactaacgccttgatcgacacgccgttcctgatgaaaaccgccgaaaccattcgcttcggtaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaatctgctgaaagtgatggaaatctgcctgcatgaaaatgaaggcaatgctgcgctgacttatgaaggtttactggagcagatccgcgccaagatcagccactacatcaccctgatggttgagggcagcaatatttgtgatatcggccatcgcgactgggcacctgtaccgctgctctcatcgtttatcagcgattgtctggaaaaaggccgcgatattaccgatggcggcgcgcgttataacttctccggcgtacaggggatcggtatcgccaacctgagcgattctctccatgcgttgaaagggatggtttttgagcaacagcgtttaagttttgacgaattgctgtcggtattaaaagccaacttcgcaacgccagaaggcgaaaaagtccgcgctcgcttaattaaccgcttcgagaaatacggtaacgatatcgacgaggtggataacatcagcgccgaactgttgcgccactactgcaaagaagtggaaaaataccagaacccgcgcggcggctacttcacgccgggatcgtataccgtttctgctcacgtcccgttgggatcggtggttggcgcgacgccagacggtcgttttgccggagaacagctggcagacggcggcttgtcacccatgctgggccaggacgcacaagggccaacagcggtactgaagtcagtcagtaagctcgataacacgctgctgtctaacggtacgttgctgaacgtgaaattcactccggcgaccctggaaggtgaagcaggattacgcaaactggccgacttcttacgggcgtttacccagcttaagttacaacatattcagtttaacgtggtgaacgccgacacgttgcgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcgatgatgtggcgcgcattttcaacattcagcgttattcactgaatgacggcgagggcattcgtacggtggtcttttttaaaggctgtccgcatctttgcccgtggtgtgctaatccggagtcgatctccggcaaaatccagacggtacgcagagaggcgaaatgtctgcactgtgcgaaatgtttgcgtgatgcggatgaatgcccctccggggcgtttgaacggattggtcgcgatatcagccttgacgctctggaacgggaagtgatgaaagatgacattttctttcgcacgtccggcggcggcgtcacgctttctggcggcgaagtgttaatgcaggcggagtttgctacccgttttttacagcgactgcggctgtggggtgtgtcatgcgccattgaaactgccggagacgcaccagccagcaagctattaccgctggcgaaattgtgcgatgaagtgttgttcgatttaaaaattatggacgcgactcaggcgcgggatgtggtgaagatgaacctgccacgcgtgctggagaatctgcgtttgctggtgagtgagggcgtcaacgtgatcccgcgtttaccgctgatccctggtttcacgctcagccgggagaatatgcagcaggcgctggatgtactgatcccgctgaatatcaggcagatccatctgttaccgtttcatcagtacggcgaaccgaaataccgcctgctggggaaaacatggtcgatgaaagaggtgcctgcgccgtcgtcagctgatgtggcaacgatgcgcgaaatggcagaacgggccggacttcaggttaccgtgggaggttaaaatggcatacctggtggcagtaaccgcctgcgtaagcggcgtggcgcatacttatatggcggcggaacggctggaaaagttgtgcctgttagagaagtggggagtcagcattgaaactcagggcgcgctgggaacggagaatcgtttagcggatgaggatatccgccgggcggatgttgctctgttgattacggatatcgagcttgccggtgccgagcgatttgaacattgccgctatgtgcaatgcagcatctacgcattcctgcgtgagccgcagcgggtaatgagcgcggtgcgcaaagtgctttctgcgccgcagcaaacccatcttattctggagtagtcggtttttctgtcagttggctgtggtactgccggcgatattccgacggcgagcgttcggtgtttttacgaaacagacggcagaagtagttgctgtcgacaaagccgcaggcgtgcgccacttcttttaccttcaggtcatagcctttcaataacgtcttagcgtgctccagtcgcgtgtgattcaggtattcgttaaaaccaatggcccccgttttttgaaacaggtgcgagaggtaatttggcgaaatataaaacgcctgtgcaacagattcgcgggtaagcgcggaggcatagcgttcgtcgatataatcgcgaatagcttcaaatagtgcctggctgcgtgaggcggtctggatttggctgccaagcaaatcgcggcagtggctaagcaggctggcgacgataagccttgccgtttgctgctcctgcggctgcatttgcatttcattgagcgtttgtagcagaaaagaacctatgcgtgggccgcgtcgggcgacgtgttgcttcgccagattttgatattgtttgccatcccattgcacgacgctgaagccgagttgctgtttgccaaacagcacgctaaaggtagtagcgggggcttgccattgtggaaaattccagccaccagcaggaacgtacagcacatcgccgggaactaacgttgctccagcgccggtatcaacaaactcaccttccagcacaatttccagccgtggaaaatcgacctgatacgcaagatcgggcaccgggccgttactgctggcaaagtaaatctggcgcagggacagcgggccgttgatcaggcgggagagcagatagctgacgtcgtgatacatgttattcccttaggtatgtagacgggaaaacagtaactggcattattaaaaaaggccacctgaaaagtgtggcctgaggggagttcgatgtaaacattgcggcagttgtattgccggatgtggcgtaaacgccttatccagcctaccgccgcgatctgtaggccggataagacgcgtcaagcgtcgcatccggcaaatagcgcctggctgataattactgattacccacctgatcgccatagggcagtgtgtcgtaatcgatcagtgcgtttttcttatacgggttaccaatccagcgggtagtttctttgaactgcggattcaccactgaacgggttggatcgtaaccgtcgtaagataagcccgccaaatctgaccaggtgtggatcagttccgccaggctgtatttacgatcaacatcctgcgagaaatcacggggatgagtcgcttgccatttttctgacgtccacagcaggaacggaatggtgtacatatgacgcgtcgggttgtcctcattacgcccctgagttttgtgcggcggcgtgtcgtaaacctcttcaccgtggtcagagaaataaaccaggaaaccgttcgggtttgctgctttaaagtctttaatcaggctggcaaccacatgatcgttatacaggttagcgttgtcataatcgttatatgactccagctcttccgcgtttaatcccggcggaacatgatcggtattgccatcaaacttgccctgattttccgggtagcggtatttgtatttgatatgcgtacccagcagatgaacaatgatcagtttcttcggcgcagggtcattcagcacttcctggaacggcttcagcacgttggtgtcgtattcacgcgcactctgcgtacgttgctggttcatgtagtactgcttgtcggtctggcgcgaaaataccgtcagcatggtattgcgggcggtcatcgtctgctggttggtgatccagaaggttttataacccgcctgtttcatcatgttcatcagcgacggctgcgtcagatacagatccgggttcttttcattggcaaaggtcagcgcctgttgcaggatttcaatggtgtacggacgagacgtaactacgttattaaacacggtcagattcggatcggttttatgcagcgcatccagctccggcgtggtttcacgcggataaccgtacagactcatgcgtccgcgctgggtcgactcgccaatcaccagcactaaagtgcgcggttcgttacccgattcatctttgaaattagccagtggcggcaaggcattattttcattcagtaactttgttagcgagtttagttgctgacgatactgataatagccggtcaggaattgccacggtgcggcaggctccatacgcgaggccaggttatccaacgttttctcaaacggcttgtttttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtagtagcacagcgccgccagagaggccgcccatagcaccacgccgattactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaagaggtttagcctggacttctgtggaatgcatagtaagaacctgtcttgaaaaaatatcgccgaatgtaacgacaattccttaaggatatctgaaggtatattcagaatttgaataaaatgcagacagaaatatattgaaaacgagggtgttagaacagaagtatttcagaaaaccctcgcgcaaaagcacgagggtttgcagaagaggaagattagccggtattacgcatacctgccgcaatcccggcaatagtgaccattaacgcttgttcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcagatgggaatcgttggcaatcgccagcaccactttgatgtcttcttcttgcaggttgcgtaactctttacctaacggccacagtgctttgtctaccaggcgttggtcatagtattccgccagccacaggtctgctttggcgaagaccatctccagcatgccgagacgcgtcgagaagaatggccaatcgcggcacatagcctccagctcgctctgtttgccgtcttcgaccactttttgcagcgccgtacctgcacccagccaggcggggagcatcagacggttttgcgtccaggcgaagatccacggaatggcgcgtagtgactcgacgccgccggttgggcgacgtttcgccggacgtgaacccaacggcagtttgcccagttcttgttccggcgtagcggagcggaagtaaggcacaaaatctttgttttcacgtacgtagccgcggtagacatcgcaggagatgactgacagttcatccataatgcgacgccagctctctttcggctccggcggtggcagcaggttggcttccagaatcgccccggtataaagcgacaggctgctgacggtgatttctggcagaccatatttaaagcggatcatctcgccctgttcggttacgcgcaggccgcctttcaggcttcctggcggttgtgacagcagcgccgcatgagcaggtgcgccgccgcgaccaatggaaccgccgcgaccgtggaacaacgtcagctcaatacccgctttttcgcaggttttgattaatgcatcctgtgcctgatattgcgcccaggaagctgccatcactcccgcatcttttgctgagtcggaatagccaatcatcaccatctgtttgccctgaatcaggccacgataccagtcaatattgagcagctgggtcatgacatcgttggcgttgttcagatcatcgagggtttcaaacagcggagcaaccggcatcgcaaacccgatacccgcttctttcagcagcaggtggacagccagtacgtcggacggcgttttcgccatcgagatcacgtaggcggcaatggagccttgcggtgcttcggcaatcacctggcaggtatcgagcacttcgcgcgtttcggcgcttggttgccagttgcgcggcagaagcggacgtttggagttcagttcgcggatcaggaacgcctgtttgtcggcctctgaccagctttcgtagtcgccgataccgaggtagcgggtcagctcgcccagcgcttcggtatgacgcgtgctctcctgacggatatcaatacggaccagcggtacgccgaaacatttcacgcggcgcagggtgtcgagcagatcgccgttggcgataatacccatgccacacgcctgaagtgactggtagcaagcgtagagcggttcccacagttcttcgttttgtgtcagcaggccttctggttttggcagttcttcgcctttcaggcgcgcttccagccatgcctgtgtcgccatcaggcgagaacgcaggtttttcatcagatagcgatacggttctgcggcaccttcttcgccaaccagcgccagcagttcaggggtcgcttcaaccatcgacagttcagaaaccagcacctgaatatctttcaggaacaaatcggtggctttccagcggctgagtagcaggacgtggcgggtgatatcggcagtgacgttcgggttgccgtcgcggtcgccgcccatccacgaagtaaaacggaccggaacaaattcgacgggcagtttgtagccgaggttctcttccagttgttcgttcagttcgcgcaggtaatttggtacgccttgccacaggctgttttccactacggcaaagccccatttggcttcatctaccgggcttggacgcagcttacggatttcatcggtatgccatgactgggcgatcaactggcgcaggcgacgcatcagctggttgtgttcgtagtcagcgatatctttgttatcgagctgttttaaacaggcgttcacttccaccattttgtggatcagtgtacgacgggtaatttcggttgggtgagccgtgaggaccagttccagcgacagcgattccactgcttttttgatggtgtcttcgctcagttccggctggtttttcagtttacgcagggtgcgggcgatcacttccgggttgctggcagcttcgcctttcggcgaaatgctgtggtattgctcggcggtgttggccaggttcaggaactgactaaacgcacgcgcaacgggcagcagctcgtcgttcgacaaattttgtaaggtggtgagcaactcctggcggttagcatcattgccagcgcgtgaagatttcgacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgtcattaaattcacgacgctttaaataagcgtaacttatggaaatgttaaaaaatcgccccaagtaacaccaaaggtgtaggtcggataagatgcgcaagtatcgcatccgacattattgcggcactggagtttggcaacagtgccggatgcggcgcgagcgccttatccggcctacagttgggcatcgtttgagtcactgtcggtcggataagatgcgcaagtatcgcatccgacattattgcggcactggagtttggcaacagtgccggatgcggcgcgagcgccttatccggcctacggttgggcatcgtttgagtcactgtaggtcggataagatgcgcaagcatcgcatccgacattattgcggcactggagtttggcaacagcgccggatgcggcgcgagcgccttatccggcctacgttttaatgccagcaaaaatggtgaattacctgggttatcagttcgcgggtgggcttgataaaccgtgtttccagatattcatcaggttgatgagcctgattaattgagccaggccccaacaccagcgtcgggcataacgtttgaataaacggcgcttcggtacagtagttcaccacttcggtttttgctccgagcaatttctcaaccacttcaaccagttgatgattcggtgggcattcatagccagggatcggcggatgcagctcgtcgaccgtcagacgacccggccagcgttcgctcaccggagccaatgcatcgttgagcaaaccattaagttcattgagtgtcatgccaggcagcggacgaatatccatatgcaactcacagcaagcgcaaatacggttagaagcgtcgccaccgtgaatatgcccgaggttgagcgtagggtatggcacggtaaacgcttcgtagtgataacgttctttcaggttatcgcgcaattgcaaaatatgcccgatggcgtcgtgcattagttcgatagcgttaactccgcgtgctggatcgctggagtgccccgactggccctgaatacggatggcgttagagatatgacctttatgtgcgcgtaccggttgtagtgacgtcggttcgccaatgatggcgcaatccgggcgcagggcggtagtttcggcaaaataacgcgctccggccatactggtttcttcatcagcagtcgccagaatgtagagcggttttttcagtttcgtgacgtcgacatcgcgtagcgcatcaaggataaacgcaaaaaagcctttcatgtcggcggtgcctaagccgtaaagcttgccgtcatgctccgtcagtgtaaacggatcgcgcgtccagcgaccgtcatcaaatggcaccgtatcggtatgccccgccagcaacaagccgccagccccctgtccgatacttgccagcatattgaatttgttgcgagttcctggaacaggctgcacttccacattgaagcccaaatctttaaaccagtccgccagcagagtgattaaatctgcattgctttgatcgagtgcctcttccgtggcgcttattgaaggtgtggcaatcagagcgcggtaaatctcgataaatggcggtaatttgtttttcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatctgattattgtggcgaccgaagacaacttactgaaaggcgcggcggcacaagcggtacagtgcgccaatattcgtttcggctatgcggaaacgcagtctcttatttaagggtgcaatgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggccgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttagggtaagaacatttatatgtataaatttgagcctggcttatcgccgggcttttttatggcaaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcattgctattctacctatcgccatgaactatcgtggcgatggaggatggataatgaatattcgtgatcttgagtacctggtggcattggctgaacaccgccattttcggcgtgcggcagattcctgccacgttagccagccgacgcttagcgggcaaattcgtaagctggaagatgagctgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcacattggtttgattcccacagttggaccgtacctgctaccgcatattatccctatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgccagcgctggctgtgccgccggagcgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagttttaaaacaggcggtttaaaccgtttaacgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcgcgtgccagatgtttaaactgggcgcggcccacttcatatggcactttcattgcggtcagctgctgttcggttttgcccacagagctgatttccgggatggtgtaaataccggtagggatatcttcaatcagatgtgcggtggcttcgccttttaccagcgcctgcgcggcaatgcgcccctggtcataggccgccgacgccaggctcggataaccaatcacgtcgcccaccgcgtaaacgtgtggctgtgcggtctgatacatgctgttgaccttcagctgtccgcggctgtcagtttctagcccaatgttctgtaacgccagcgaatcggtattaccggtgcgaccgttggcatagagcaggcagtcagctttcagttttttacccgacttcagatgcatgatcacaccatcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccatagataagtacatggcgcggttcgtggtgcatgctgagaattgagtcgctgtcgtaaatgcgtggatgggtgaaatcaacatctgttggatgatatggacgagagccgcaggcaataacaaatttttcagcggttagtgtttcaacgctgccgtccgggcaatccagcgccaacgtatgctcgtcaacaaagcgagcgtttccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggcatggtagggcttacctgttcttatacataaaagcaacagaatggtaacattttatcgcgggtaagccaattgatccccgtcatttatctggctatatcctgagcggcctttgctttgtctgtttcttacttttgccctgacgttttattggatttttatcgacgatactctccgtttaagcggcaggtttccgctgtacgtaaaagaaccggccaaagaattgcagtaaatatgttttattgcgttaccgttcattcacaatactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcgcgtgaagcgggcattgctcccacctctttttatcggcatttccgcgacgtagacgaactgggtctgaccatggttgatgagagcggtttaatgctacgccaactcatgcgccaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacaattgtcttcagtgcgggtgccgaggcgttggacgtcggcgtcgaacaacgtcggcaattagaagagcgactggtactgcaactgcgaatgatttcgaaaggggcttattactggtatcgccgtgaacaagagaaaaccgcaattattccgggaaatgtgaaggacgagtaatgaaacaagcaaatcaagatagaggtacgctgctgctggcgttagttgctggcttatcgattaatggtactttcgcagcgctgtttagctccattgtgccattttctgtattcccgattatttccctggtgctgacggtttactgcctgcatcaacgttatcttaatcgcactatgccggtaggcttgccgggtctggcagctgcctgttttattctcggcgtactgctgtacagcacggtagttcgtgcggaatatccggatatcggctctaacttcttcccggcagtactctccgtcattatggtgttctggattggcgcgaagatgcgtaaccgtaagcaggaagttgctgagtaatcggtattatgccggatgctggcgcatccggcatgggttttacttcgcggtcagtaatacgccgcactccatatggtgcgtgtaggggaactgatcaaacagagccagacgttcgaccttgtgcgtctggcttaatgtttccagattcttgcataacgtttccgggttacaggagatgtacaaaatacgcggatacgcctgcaccattttctcggtttcactgtccagaccgctgcgcggagggtcgacaaaaatggtttcgcactgataactctttaagtcgatcccttgcaggcggttaaactcgcgcacaccattcatcgcctgagtaaattcttctgccgccatacgaataatttgtacgttatcaatatggttagctgcgatgttgtattgcgcagcagcaaccgacggcttagcgatttcggtggctaatacccgatcaaaattacgcgccagcgctaatgaaaagttaccgttgccgcagtacagctccagtaaatcgccttttgagcctttggttacgtccagcgcccattccagcatctgaatattcatcgccgcgttcggctgggtaaagctgttttctacctgacggtagatcatctctttccctgcgaccggcagacgttcatcgatgtaatcctgatccagctcgattttggttttcgttgcccgaccaatcagatgcacattcagattctgcgcgcgcagtgcatcgcgcagggcctccgcttcctgacgccactcatcatccagcttcttatggtatagcagggaaaccaccgcctgattactcagtgtagtgaggtaatcaatctggaacaacttgtggcgcagaacgggattattacgcacacccgcaatcatcgccgtcatcaactggttgataagttcactggcggcggggaagctatccacgcggatgcggcttttggtttgttgatcgaaaatgatgtgatacaggtcatcgccatcgtgccagatgcggaactccgcgcgcatccggtaatgactgaccggcgagcgaaacacttccggaaccaggtcagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagttaatagggaatccagtgcgaatctggagctgacgcgcagcggtaaggaaaggtgcgatgattgcgttatgcggacactgccattcggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttccgtcacggcattttccgcttgggcacaggataccagcccggatactctcgtcgttactgctaaccgttttgaacagccgcgcagcactgtgcttgcaccaaccaccgttgtgacccgtcaggatatcgaccgctggcagtcgacctcggtcaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggtgagtggttctgccgaccttagccagttccctattgcgcttgtccagcgtgttgaatatatccgtgggccgcgctccgctgtttatggttccgatgcaataggcggggtggtgaatatcatcacgacgcgcgatgaacccggaacggaaatttcagcagggtggggaagcaatagttatcagaactatgatgtctctacgcagcaacaactgggggataagacacgggtaacgctgttgggcgattatgcccatactcatggttatgatgttgttgcctatggtaataccggaacgcaagcgcagacagataacgatggttttttaagtaaaacgctttatggcgcgctggagcataactttactgatgcctggagcggctttgtgcgcggctatggctatgataaccgtaccaattatgacgcgtattattctcccggttcaccgttgctcgatacccgtaaactctatagccaaagttgggacgccgggctgcgctataacggcgaactgattaaatcacaactcattaccagctatagccatagcaaagattacaactacgatccccattatggtcgttatgattcgtcggcgacgctcgatgagatgaagcaatacaccgtccagtgggcaaacaatgtcatcgttggtcacggtagtattggtgcgggtgtcgactggcagaaacagactacgacgccgggtacaggttatgttgaggatggatatgatcaacgtaataccggcatctatctgaccgggctgcaacaagtcggcgattttacctttgaaggcgcagcacgcagtgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcgattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgctttcccgtatggcgaaaaaagcgaagcgtttattgttgagcgagtggtggcaattgtcaccgcggtgcaagaacgttatccccttgcgctggctgtggtcgcttgcaacactgccagtaccgtttcacttcctgcattacgcgaaaagttcgacttcccggttgttggtgtcgtgccggcgattaaacctgctgcacgtctgacggcaaatggcattgtcggattactggcaacccgcggaacagttaaacgttcttatactcatgagctgatcgcgcgtttcgctaatgaatgccagatagaaatgctgggctcggcagagatggttgagttggctgaagcgaagctacatggcgaagatgtttctctggatgcactaaaacgtatcctacgcccgtggttaagaatgaaagagccgccagataccgttgtattgggttgcacccatttccctctactacaagaagaactgttacaagtgctgccagagggaacccggctggtggattctggcgcagcgattgctcgccgaacggcctggttgttagaacatgaagccccggatgcaaaatctgccgatgcgaatattgccttttgtatggcaatgacgccaggagctgaacaattattgcccgttttacagcgttacggcttcgaaacgctcgaaaaactggcagttttaggctgatttggttgaatgttgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgtagtgctcacacagattgtctgatagaaagtgaaaagcaaggcgtttacgcgttgggagtgaggctgaagagaataaggccgttcgctttctattaatgaaagctcaccctacacgaaaatatcacgcaacgcgtgataagcaattttcgtgtccccttcgtctagaggcccaggacaccgccctttcacggcggtaacaggggttcgaatcccctaggggacgccacttgctggtttgtgagtgaaagtcgccgaccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgaccctttaagggtcctgaaggaacgttgaagacgacgacgttgataggccgggtgtgtaagcgcagcgatgcgttgagctaaccggtactaatgaaccgtgaggcttaaccttacaacgccgaagctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttcctgtcgtcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagtatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgtctggtaaaatacactttgcaggaaggtatgcctggtctggaaaatctggcattaattcctggttgtgtcggctcatcacctatccagaatattggtgcttatggcgtagaattacagcgagtttgcgcttatgttgattctgttgaactggcgacaggcaagcaagtgcgcttaactgccaaagagtgccgttttggctatcgcgacagtatttttaaacatgaataccaggaccgcttcgctattgtagccgtaggtctgcgtctgccaaaagagtggcaacctgtactaacgtatggtgacttaactcgtctggatcctacaacagtaacgccacagcaagtatttaatgcggtgtgtcatatgcgcaccaccaaactccctgatccaaaagtgaatggcaatgccggtagtttcttcaaaaaccctgttgtatctgccgaaacggctaaagcattactgtcacaatttccaacagcaccaaattacccccaggcggatggttcagtaaaactggcagcaggttggcttatcgatcagtgccagctaaaagggatgcaaataggtggggctgcggtgcaccgtcaacaggcgttagttctcattaatgaagacaatgcaaaaagcgaagatgttgtacagctggcgcatcatgtaagacagaaagttggtgaaaaatttaatgtctggcttgagcctgaagtccgctttattggtgcatcaggtgaagtgagcgcagtggagacaatttcatgaaggataacaccgtgccactgaaattgattgccctgttagcgaacggtgaatttcactctggcgagcagttgggtgaaacgctgggaatgagccgggcggctattaataaacacattcagacactgcgtgactggggcgttgatgtctttaccgttccgggtaaaggatacagcctgcctgagcctatccagttacttaatgctaaacagatattgggtcagctggatggcggtagtgtagccgtgctgccagtgattgactccacgaatcagtaccttcttgatcgtatcggagagcttaaatcgggcgatgcttgcattgcagaataccagcaggctggccgtggtcgccggggtcggaaatggttttcgccttttggcgcaaacttatatttgtcgatgttctggcgtctggaacaaggcccggcggcggcgattggtttaagtctggttatcggtatcgtgatggcggaagtattacgcaagctgggtgcagataaagttcgtgttaaatggcctaatgacctctatctgcaggatcgcaagctggcaggcattctggtggagctgactggcaaaactggcgatgcggcgcaaatagtcattggagccgggatcaacatggcaatgcgccgtgttgaagagagtgtcgttaatcaggggtggatcacgctgcaggaagcggggatcaatctcgatcgtaatacgttggcggccatgctaatacgtgaattacgtgctgcgttggaactcttcgaacaagaaggattggcaccttatctgtcgcgctgggaaaagctggataattttattaatcgcccagtgaaacttatcattggtgataaagaaatatttggcatttcacgcggaatagacaaacagggggctttattacttgagcaggatggaataataaaaccctggatgggcggtgaaatatccctgcgtagtgcagaaaaataagaaaggggagtattcgctcccctgcaaattatttgcgtagtctgacctcttctaccgcatgattagcacttttcgtcaggattaaactggcgcgctcacgagtaggtagaatattttgctttaagttcagccagttgatctctttccacaatgtcatggcagtcttaatcgcttcttctttagttaatttcgcgtagttatgaaaataggaatccgggtcggtaaaagccccttcgcggaatttcagaaaacggttgatataccatgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaaccgttttatctccatccgggatcacatcataaataagatgtgagtaaacaggtgctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactgccagcaatactgataatgtaaggaatgcgttgcccgttggtaccaagaaactgttccagaactgcctgacggcgcagattcgagcttatatagaagttcagcaaacgtgacaaaggtaaatagatctcggcaacttcttctaacgagagatcttcattaatacctttgagacgggcgatctcatcttccgataacgtcataggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctgccaggaagctatcgttgaaaagcaatgtgacagatattccatctgataaaaagaattatggtttagcaggagcgcattgttgagcacaatgatgttgaaaaagtgtgctaatctgccctccgttcggctgtttcttcatcgtgtcgcataaaatgtgaccaataaaacaaattatgcaattttttagttgcatgaactcgcatgtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgcgcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaaaacttctgacaggttggtttatgagtgcgaataccgaagctcaaggaagcgggcgcggcctggaagcgatgaagtgggtcgttgtggtggcattgctcctggtggcgattgtcggcaactatctttatcgcgacattatgctgccgctgcgtgcgctggccgtagtaattctgattgctgcagcgggtggtgtcgcgctgttaacgacaaaaggtaaagctaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagatttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgctgtttgaaccgggtgaaatggtccgtgttaatgatggtccgttcgctgacttcaacggtgttgttgaagaagtggattacgagaaatctcgtctgaaagtgtctgtttctatcttcggtcgtgcgaccccggtagagctggacttcagccaggttgaaaaagcctaacccagcgatcaaaaaagcggcgatttaatcgttgcacaaggcgtgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcaccgtttacgctgaccgttctttcactttcgttaccaagaccccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgcactgctgaaagagctggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccaaggtgcaaacgctgaagctgctaaagctgcaggcgcagaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacaccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctccaccaccatgggtgcaggtgttgcagttgaccaggctggcctgagcgcttctgtaaactaatgcctttacgtgggcggtgattttgtctacaatcttacccccacgtataatgcttaatgcagacgtatatccgagatattcgggttgtggcaaggcggcaactgagtgagtcgccaggagcatagctaactatgtgactggtgcgaatgaaggaagccaacgccgtcacaagctgaatagcgacggatagaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacaggacgtccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacagacaacggtacctttgttatcaacggtactgagcgtgttatcgtttcccagctgcaccgtagtccgggcgtcttctttgactccgacaaaggtaaaacccactcttcgggtaaagtgctgtataacgcgcgtatcatcccttaccgtggttcctggctggacttcgaattcgatccgaaggacaacctgttcgtacgtatcgaccgtcgccgtaaactgcctgcgaccatcattctgcgcgccctgaactacaccacagagcagatcctcgacctgttctttgaaaaagttatctttgaaatccgtgataacaagctgcagatggaactggtgccggaacgcctgcgtggtgaaaccgcatcttttgacatcgaagctaacggtaaagtgtacgtagaaaaaggccgccgtatcactgcgcgccacattcgccagctggaaaaagacgacgtcaaactgatcgaagtcccggttgagtacatcgcaggtaaagtggttgctaaagactatattgatgagtctaccggcgagctgatctgcgcagcgaacatggagctgagcctggatctgctggctaagctgagccagtctggtcacaagcgtatcgaaacgctgttcaccaacgatctggatcacggcccatatatctctgaaaccttacgtgtcgacccaactaacgaccgtctgagcgcactggtagaaatctaccgcatgatgcgccctggcgagccgccgactcgtgaagcagctgaaagcctgttcgagaacctgttcttctccgaagaccgttatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttccgttggcgaaatggcggaaaaccagttccgcgttggcctggtacgtgtagagcgtgcggtgaaagagcgtctgtctctgggcgatctggataccctgatgccacaggatatgatcaacgccaagccgatttccgcagcagtgaaagagttcttcggttccagccagctgtctcagtttatggaccagaacaacccgctgtctgagattacgcacaaacgtcgtatctccgcactcggcccaggcggtctgacccgtgaacgtgcaggcttcgaagttcgagacgtacacccgactcactacggtcgcgtatgtccaatcgaaacccctgaaggtccgaacatcggtctgatcaactctctgtccgtgtacgcacagactaacgaatacggcttccttgagactccgtatcgtaaagtgaccgacggtgttgtaactgacgaaattcactacctgtctgctatcgaagaaggcaactacgttatcgcccaggcgaactccaacttggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgcgctgataagccgctggttggtactggtatggaacgtgctgttgccgttgactccggtgtaactgcggtagctaaacgtggtggtgtcgttcagtacgtggatgcttcccgtatcgttatcaaagttaacgaagacgagatgtatccgggtgaagcaggtatcgacatctacaacctgaccaaatacacccgttctaaccagaacacctgtatcaaccagatgccgtgtgtgtctctgggtgaaccggttgaacgtggcgacgtgctggcagacggtccgtccaccgacctcggtgaactggcgcttggtcagaacatgcgcgtagcgttcatgccgtggaatggttacaacttcgaagactccatcctcgtatccgagcgtgttgttcaggaagaccgtttcaccaccatccacattcaggaactggcgtgtgtgtcccgtgacaccaagctgggtccggaagagatcaccgctgacatcccgaacgtgggtgaagctgcgctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcctctgacgttaaagactcttctctgcgcgtaccaaacggtgtatccggtacggttatcgacgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaagctcgacaaactgccgcgcgatcgctggctggagctgggcctgacagacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggtcgtcacggtaacaagggtgtaatttctaagatcaacccgatcgaagatatgccttacgatgaaaacggtacgccggtagacatcgtactgaacccgctgggcgtaccgtctcgtatgaacatcggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatacggcgcagcatacaccctgcaggaaatgctcaccgttaagtctgatgacgtgaacggtcgtaccaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcgggttaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggtctgctgctcgatatgccgctgcgcgatatcgaacgcgtactgtactttgaatcctatgtggttatcgaaggcggtatgaccaacctggaacgtcagcagatcctgactgaagagcagtatctggacgcgctggaagagttcggtgacgaattcgacgcgaagatgggggcggaagcaatccaggctctgctgaagagcatggatctggagcaagagtgcgaacagctgcgtgaagagctgaacgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggtagacgccctgctggataacggtcgtcgcggtcgtgcgatcaccggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggagctgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgtgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttactccatcgtcaaccaggcgctgggtaaaaaagcaatctccaaaatgctgaacacctgctaccgcattctcggtctgaaaccgaccgttatttttgcggaccagatcatgtacaccggcttcgcctatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgtgattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtacccatgaaggtatcatgatgactccggttatcgagggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaagggtgaagcaatcggtgttatcgcggcacagtccatcggtgaaccgggtacacagctgaccatgcgtacgttccacatcggtggtgcggcatctcgtgcggctgctgaatccagcatccaagtgaaaaacaaaggtagcatcaagctcagcaacgtgaagtcggttgtgaactccagcggtaaactggttatcacttcccgtaatactgaactgaaactgatcgacgaattcggtcgtactaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggccagaccattacgcgtcagaccgacgaactgaccggtctgtcttcgctggtggttctggattccgcagaacgtaccgcaggtggtaaagatctgcgtccggcactgaaaatcgttgatgctcagggtaacgacgttctgatcccaggtaccgatatgccagcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgttactcgttacatcgttaacgaagtacaggacgtataccgtctgcagggcgttaagattaacgataaacacatcgaagttatcgttcgtcagatgctgcgtaaagctaccatcgttaacgcgggtagctccgacttcctggaaggcgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaatcgttaatccgcaaataacgtaaaaacccgcttcggcgggtttttttatggggggagtttagggaaagagcatttgtcagaatatttaaggaatttctgaatactcataatcaatgtagagatgactaatatcctgaaactgactgaactaattgagtcaaactcggcaaggattcgatactattcctgtgtaactttcttaaggaacgagaatgaaacaggaagtggaaaagtggcgaccttttggacatccggatggtgatattcgtgatttatcatttcttgatgctcatcaggctgtctacgttcagcatcatgagggcaaagagcctttagagtatcgcttttgggttacctactctcttcactgcttcacaaaagattatgaacatcagacgaacgaagaaaaacaatcgttaatgtaccacgcgcctaaagaatctcgtcccttctgccagcaccgttataacttagcgcgcacacacttaaaaagaactattttggcgctgccagaaagcaacgttattcatgccgggtatggtagctatgccgtgattgaggtggacttagacggaggagataaggcattttactttgttgcgttcagggctttcagggaaaagaaaaaactccgtttgcatgtaactagcgcttatcccatttctgaaaaacagaaaggtaaatcagtgaaatttttcaccattgcctacaacttattgagaaataagcagcttcctcagccctcaaaataacaaaacccaccttaaggtgggtttcgccagagaattatctctggtattcagaacgccattaccggactttgccttgaccttgcgataatcgcaggttgcgggatgtctgaatttcttcagtctgctgcatcctggaagatgagaacatgtgttcttattttcgtctctatcatagttgagtatttactctcttacaatcagatctctttcattgctcaacaggcgatggcttcagactttgcattacggaatttttaagaaaggcagggcgaaacgaggaagaagcttttcgccctggacaacattcctgctgacggcactaccataaaaaaacacaacgctttcaacaaccttgcgtttttcatcttccgtagcggctcggaataaatttacgttcttacattccgtctcatagtctttgcgaggcgcgtcccagatagctgtcccagtctttccataccggctgcaaaccctgagcggttaacgcggcagcaaccgcttccggtctgcgatcgtcgtgcggtgagaactgttccaactcggggtgattatcggcatagccacctggctgcgttttcgagaaggcgctgacgttattgatcgccagcggaataacgcgatcgcgaaaccacggtgattcccgcgtggagagtgacagttcaatctccggtgcaagcagtcggaaggcgcagatggtttgcactaactggcgttcatccataatcgacgcaggctcaatgccgccagtacacgggcgcaggcgcggaaaggagacagagtaacggctttgccagtaatgctgttgcagccatagcaaatgttcggcaaccatatagctgtcaacgcgccagttgtcggaaaggccaattagcgcgccgaggcctatcttatcaatccccgcacgccccagccgatccggcgtttccagccgccagaagaagtcctgttttttgcctttcagatgatggcgggcataagtcgcctcgtgatatgtctcctgataaaccatcacgccatccagaccaagttgctttaactcggcgtattccgtctccgccagcggttgcacttccatctgtagtgaagagaactgttcacgaagggcagggagatgacgacgaaagtaatccatccccactttcgcctgatgttcaccagtgactaacagcagatgttcaaagcccatctcccgtatagcggcactttccctggcaatatccgcttcatccagcgttttgcgcttgatgcgattactcatggaaaatccacagtacgtgcagtcgttagcgcaaagattggaaagataaagcgggacgtagaaactaactgtgttgccaaatcgctgacgggtcagacgctgcgcccgttgggccagttgttccagatagccactggcggcaggcgataacagcgccatcatgtcgtcgcgggtgagttgcgaggcatttagcgcccgctctacgtcagcagccgttttgccgttgatacgcaggcggatgtcgtcccagtccagttgtcgccagcgatcgctgaaggttttcatgccgatgcctccagaaatccggtcagcgggctggtggcatgagcaaaataactgcggctgcccggtccggactgacgtgccagtaggcctgcttctaccgccagacgaaatgccttcgccatgttgacgggatcgtccgcgacggcaatcgccgtattcactaacaccgcgtcggcccccatttccagcgcctgcgcggcatggctgggaacgccgatgccagcatcgacaaccaccggcactgtggcctgctggataataatctccagcatggcgcgggtttccagtccctgattcgagccaatcggcgcgccgagcggcatcaccgctgcacagccgacttcttccagacgtttacacaataccggatcggccccgcagtaaggcagcacgacaaatccctgttgtaccagcgtttcggcggctttcagggtttcgatgggatcgggcaacagccagcgggcgtcagggtgaatctctaattttaaccagtttgtgcctaacgcttcacgagccagatgggcggcgaaaatggcttcttccgctgttttcgccccggatgtatttggcagcagggtcacacccgccgcgataagcggttcgaggatagcgtcgttgtgctggcgcaagtcgacacgtttcatcgccagtgtcaccagctggctgccggaagcgcggatcgcctccaccatcagttgtgaagaagcgaatttccctgtgccggtaaacagatgtgaatcaaacgttttgtccgcaatacgtaacatttcaaccccctgcaataacctgaaaaagcaggatctggtcgccatcctgcacgatatgttgcgcccactgctcacgcgggacgatttgctgattaatcgccagagccgcgcccgcttgtcgttggtcgagttgctccagtagttcgtgaacagtttgcccggcggcgcactgcatcgcttgatcgttaaacaggatctgcattgcttcctccgcataccgggcaaccactggcgcggcgcaacgccaggctgcgccactggctcgatttaccgtcgaacagtcggagttctcccgcaggtgtctctataccgcttaataacttaatggcttccagtgcctgcaaagtgcccataaccccgaccaccgggccaaccacgcccgccgtgcggcagttgcgttctggctcctggttatctggccacaggcagcggtaacacccctgctcccagggcggcgtcagtaccatcaactgaccgccaaatccgaccgcgctggcggtgataagcggcgtgttgagtgccacgcaggcggcattaatctcctggcgagtcgccatattgtcggtacagtcgagcaccacatcggcccgtgcaaccgcatcttttaacgcctcacccgttaaccgttgttgtaatgctgtcagttgaatgtcgggattcaactgtgtcagtcgctgttggctgacctgcgatttcgggcgatcgatatcttcagtggtaaagaggatttgtcgttgcagattgcttaaatgcacatcgtcgtcatctgccagtaccagcgtcccgacgccagcgcccgccaggtacagcgcagcaggtgtacccagcccgcccagaccgataatcagcacctggctgtcgagcagtttttgctgcccgtccagagcgatatcgtcgagcaggatttggcggctataacgcataaagtcacggtcattcatcgccaactcctgcaatttccagcaactgtgccgttgccaaacgccagtctgcggcttgagtaatggcgctgacgacggcgatactgccgacacccgttgctatcaccgcaggcgcgcgtgccagactgataccgccaatcgccacggtgggataatccgccagtcgctcaacatgccgtgccagctgttccagcccctgcggtgcagaaggcatctgtttggtttgcgtcgggaacacatgtcccagcgcgatataagaggggcgtgctgccagcgcgacgtcgatttccatatcgtcatgtgtcgaaacgcccagccgcaggcctgccgcgcggatggcattgagatcggtggcttgcaaatcttcctgccccaaatggacgccatacgcctgatgcttgatcgccagccgccagtaatcgttgataaacaatcgcgcgttatagcggcggcccagcgcaattgccgccacgacatcggcttccacctcttcatcgcgccgatctttgatgcgtagctggagagtacgtacgcctgcatccaacagacgttcgatccactgtacgctgtccaccaccgggtacagtcctgaacgaaaaggtacaggaggaaaatcaggctgatacatcacgcttcctccttacgcaggtagatttctccgcctctggcacggaagttctccgacatatccgccattcccatttcaatagtttgcgtggcggcgtaatcacgcacttcctggctgattttcatcgagcagaatttcggcccacacatggagcaaaaatgggcgactttacctgactcttgcggcagggtttcatcgtgataagcgcgggcggtaaacgggtcgagggccagattaaactggtcttcccagcgaaattcgaagcgggctttcgacatggcgttatcgcgaatttgcgcgcccggatgccctttcgccaggtcagcggcgtgggcagcaatcttataggtgataagcccctgcttaacatcttctttattgggcagacccagatgctcttttggcgttacgtaacagagcatcgcgcagccaaaccagccaatcatcgccgcaccaatccccgacgtgaagtggtcatagcccggcgcaatatcggtagttagcggccccagagtgtaaaacggcgcttcgtggcagtgctctaactcctcggtcatattgcggcggatcatctgcatcggcacgtggcctgggccttcaatcatcacctgcacgtcatattcccaggcaattttggtcagttcgcccagcgtatgcagctcggcaaactgcgcttcatcgttggcgtcctgaatagaaccggggcgcagaccgtcgcccagcgacagcgaaacgtcataagcggcacagatttcacaaatttcgcggaagtgttgatagaggaaattttcctgatgatgggagaggcaccatttcgccataatcgaaccgccgcgagagacgataccggtcaggcgtttcgcggtcatcggcacatagcgcagcagtacgcccgcatggatagtgaagtaatccacaccttgctcggcctgttccagcagcgtgtcgcggaacgcttcccaggtaagatcttcggcgatcccgttaaccttctccagcgcctggtagatcggcactgtaccgatcggcaccgggctgttacgcaaaatccactcgcgggtttcgtgaatatagcgaccggtggagagatccatcaccgtatccgctccccagcgcgtggaccataccagcttttccacttcttcttcgatggaagaggtgaccgccgagttgccgatattggcgttaacttttaccaggaaattgcgaccaataatcatcggctccgattccggatgattaatgttggccgggataatcgcacgtccggcagcaacttcatcacggacaaattccgcagtgatattttccggcagatgtgcgccaaagctcattcccggatgctggtggcgtaaaacctcgctacggatgcgctcgcggcccatattctcgcggatggcgatgaattccatttccggcgtgatgatgccctggcgggcgtagtgcagttgggtgacacggcgtcctgctttggcgcgttttggtgttagtacgccgctaaaacgcagttcgtcgaggccatcatctgccagccgcgctttagtgtaatcggaactgcgcacggtaagttcttcggtatcgccgcgcgcatcgatccacggctggcgtagttttgccagcccttgctgcacgttaatggcaatctgcggatcaccatacgggccggaggtgtcgtagaccggaatcgcttcgttttcttcgtactgcggctgttctttgctaccgccaattagcgtcgggctaagctggatctcacgcatcggcacgcgcacgccggggtgtgtgccagtgatataaatgcgttttgagttgggaaaggcggtgccttccagggtgtcgataaaatgttgggcccgggcgcgttgttcgcggcgggtcagttttgttgcagacatagctcattccaaaaagttaaggacgtggcttgtcagacgacggatgaagcaagagacgatcgccgcaggggcgatgcgatagcagattaactcttgttcccttcgcaggtattagcctgatcaggttccgcggatcccgaataaacggtctcagccagttaaggcactccgacaagaaattagccccgcaaatggggcattgaatgtaaattacgcgttaacagcgcagaactcaagcaggatgtttgacgcgggcggcgtcaagcaccagcagaatcagcttatcttccagcacaaagcgcgcttccagcgcctcgccgatgtcagataaaacctgttgaaactcaaggtaattatcatgatcgatggcggtttccagactggaatcgtagtaatccataatctgttgagtattggcttcgagttgcggccaaatcttcgcggcgcgcgcgagttgcccgttgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctcagtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaacagcagcggcgtcacgatatggggtcggtacgtcaggtcattgatctcgatgttgggctgtttcaactggccggacgaggcgtacaactggcggagttttaccgatcgcataaatactgtggttactgcgggcatgaaatgtatccgagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggcgaaaccctcgagcaggcagtcgcgcgggaagtgatggaagagagcggaattaaagttaaaaacttgcgttacgtgacttctcagccgtggccgtttcctcagtctttaatgaccgcgtttatggcggaatatgacagcggcgacatcgtgatcgacccgaaagaattgctcgaggcgaactggtatcgctatgacgatttgccgttactcccgccgcccggcaccgtagcgcgccgtctgatagaagatacggtggcgatgtgtcgggcagagtatgagtgatgatacactgaccgcctgacgcactaaggaacagccaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcaggcgattttatgtcgctgtgcaaaaacgccgagctggcgtgcgaagtgactttgcaaccgctgcgtcgctacccgctggatgcggcgatcctcttttccgatatcctcaccgtgccggacgcgatggggttagggctctattttgaagccggagaaggtccgcgttttacctcgccagtcacctgcaaagctgacgtcgataaactgccaattccggacccggaagatgaactgggttacgtgatgaacgcggtgcgtaccattcgtcgcgaactgaaaggcgaagtgccgctgattggtttttccggcagcccgtggacgctggcgacctacatggtggaaggcggcagcagcaaagccttcaccgtgatcaaaaaaatgatgtatgccgatccgcaggcgctgcacgctctgctcgataaactggcgaaaagcgtcactttgtatctgaatgcgcagattaaagccggtgctcaggcagtgatgattttcgacacctggggcggcgtgcttaccgggcgcgattatcaacagttctcgctctattacatgcataaaattgttgatggtttactgcgtgaaaacgacggtcgccgcgtaccggtcacgctgtttaccaaaggcggcggacagtggctggaagccatggcagaaaccggttgcgatgcgctgggcctcgactggacaacggacatcgccgatgcgcgccgccgtgtgggcaataaagtcgcgttgcagggtaatatggatccgtcgatgctgtacgcgccgcctgcccgcattgaagaagaagtagcgactatacttgcaggtttcggtcacggcgaaggtcatgtctttaaccttggtcacggcattcatcaggatgtgccgccagaacatgctggcgtgttcgtggaggcagtgcatcgactgtctgaacagtatcaccgctaaggagtgattatggatctcgcgtcattacgcgctcaacaaatcgaactggcttcttctgtgatccgcgaggatcgactcgataaagatccaccggatctgatcgccggagccgatgtcgggtttgagcagggcggagaagtgacgcgagcggcgatggtgctgctgaaatatccctcgcttgagctggtcgagtataaagttgcccgcatcgccaccaccatgccttacattccaggttttctttccttccgcgaatatcctgcgctgctggcagcgtgggagatgctgtcgcaaaagccggatttagtgtttgtcgatggtcatgggatctcgcatcctcgccgtcttggcgtcgccagccattttggcttattggtggatgtgccgaccattggcgtggcgaaaaaacggctctgcggtaaattcgaaccgctctccagcgaaccgggcgcgctggccccactgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcggtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcatgtcactttcatggcttgcttatgcgaacgcatgtaccccaattacgccatgttctgccagcaaaccggttttggtgatgggcaaatttaccgtcgcattctcgatctcatctgggaaacgctgaccgttaaagacgcaaaagtaaatttcgacagccaactggagaaatttgaagaagcgattccttcagccgacgatttcgatctgtacggcgtttatccggcaatcgatgcctgcgtggcgttaagtgaactggtccattcgcgtttgagtggtgaaacgctcgaacacgcggtggaagtgagtaagacctccatcacgaccgttgcgatgctggaaatgactcaggctggtcgcgaaatgagcgatgaagagcttaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggctggcgctctgcttctcactgcctgtagtcataactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaaccgccggtgaatattcgcgcgcgttttgacgatcgcggtgatctgagctttatgcaacgtgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggaacagaccgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttagtggcaaactctgatttctgtcgctggcaacccaacgagaaaacgttctgatttaccagtggcccatacccatatgaccgccaccaccgcagccgccgtagcccatgcccattccggctccgcgcggaatacccgcttcagccatcgcgatatctcgtttcacccgtaactcatctaacgactgacgcaaattctccatctctttggcgaccgcgttaattttgctgctatccggtgggttcgcggctaacagggcattgtattcataacgcttcgtcaccagttgctgttgcagtgcgctgctttgagcgtaaaagtcattatggattttctgccacgctgtctgttgttcgctggtcaaaggcgcggcattttgctgccacataccgtgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacgatgaaacgctgatatgacgggtaatctggcatgataaacgagtaaaaatgactcgcctgctgcgggtagcgagtcatttttactcattgaaacttaagcctttgtgttacagcgcagggtaagcgctgataaaagatggcatgatttctgctgtcagaaagggatgagcaggcaaagaagaagatgcgttttatgcaacgttctaaagactccttagctaaatggttaagcgcgatcctccccgtggtcattgttgggctggtgggattgtttgcggtaactgtgattcgtgattatgggcgggcaagcgaggcagaccgccaggcattactggaaaaaggtaatgtgcttatccgcgctctggagtcgggaagccgcgtagggatggggatgcgaatgcaccatgtacagcaacaggcgcttctggaagagatggcgggacagccgggagtgttgtggttcgcagtcaccgatgcgcagggcatcattattcttcatagcgaccccgataaggtcgggcgtgcgctctattcgccggatgaaatgcagaaattaaagccagaggaaaactcccgctggcggctgcttgggaaaacggaaactacgcctgcacttgaggtctatcgtttgttccagccaatgtcagcgccctggcggcatggaatgcacaatatgccgcgctgtaacggcaaagctgtgccacaagtagatgcacaacaggctatttttatcgccgttgatgccagtgatctggttgcaacccagagtggggaaaagcgcaataccctgattatcctcttcgccctggcgacggtcttgctggcaagcgtattgtcattcttctggtatcgccgctatctgcgctcgcgccagcttctacaagatgaaatgaagcgcaaagagaagctggtggcgctggggcatcttgcggcaggcgttgcccacgaaatccgtaacccactttcctcgattaaaggactggcgaaatactttgccgagcgcgcgcctgcagggggagaagcgcatcaactggcgcaggtgatggcgaaagaggccgaccgtttaaaccgcgtggtaagcgagttgctggaactggttaagccaacgcatctggctttgcaggcggtggatctcaacacgctgattaaccactcattacagctggtaagtcaggatgcaaacagccgggagatccagttacgctttaccgccaacgacacattaccggaaattcaggccgacccggacaggctgactcaggtcctgttgaatctctatctcaatgctattcaggcgattggtcagcatggcgtgattagcgtgacggccagcgaaagcggcgcgggcgtgaaaatcagcgttaccgacagcggtaagggaattgcggcagatcagcttgatgccatcttcactccgtacttcaccactaaagccgaaggcaccggattggggctggcggtcgtgcataatattgttgaacaacacggtggtacaattcaggtcgcaagccaggagggaaaaggctcaacgttcaccctctggcttccggtcaatattacgcgtaaggacccacaaggatgacgcacgataatatcgatattctggtggtggatgatgacattagccactgcactattttgcaggctttactgcgcggctggggctataacgtcgcgctggcgaacagcgggcgacaggcgttggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaagcgctcgcgcatacgcacagtattgatgctgaaacacctgcggtgactgccagccagttcggtatggtcggtaaaagcccggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagattatctcggttgatgtccggctgattgcggcgacccatcgcgatcttgccgcagaggtgaatgccgggcgttttcgccaggatctctactatcgcctgaatgtggtggcgattgaagtaccatcgctgcggcaacggcgggaagatatccctctgctggctggccattttctgcagcgctttgccgagcgtaatcgcaaggcggtaaaaggttttacgccccaggcgatggatctgttgattcattacgactggccgggaaatattcgtgagctggaaaacgcggtggaacgggcagtggtgctgctgaccggggaatatatttccgaacgcgagctgccgctggcgattgccagtacgccgatcccgctgggacaaagtcaggatattcagccgttggtggaagtggaaaaagaggtgattctggcggcgctggagaaaacgggcggcaacaaaaccgaagccgcccgtcagttagggatcacgcgcaaaacgctattggcaaaactgtcgcgttagttctgctcgcgttcgatagcgcgccagccgatatctttccggcagaagcagtcgtcccagtggatatcggtcattaaggcataggcgcgtttctgcgcttctgccacggtatgacccagcgcggtgacgcacagtacgcgcccgccgttggtcactacctgctcgtcatccgccagttttgtgcccgcgtggaacactttgccgcctgccacttcttccagcggcaggccgtggatcacgtcaccggtgcggtaatcacccggatatccacccgcagccatcaccacgccgagagaagcgcgttcatcccactcggacgttttctcgtccagtttgctttcacaggccgccaggcagagctcaaccagatcggacttcatgcgcagcataatcggctgggtttccggatcgccaaagcggcagttaaattcaataaccttcggattgccctgtttgtcgatcatcaggcccgcgtagagaaaaccggtgtaggtgttgccttccgccgccatgcctttcacggttggccagataatacgttccatggtgcgctgatgaacgtcatcggttactaccggcgcgggggagtaagcgcccatcccgccggtgtttggtccggtatctttatcgcctacgcgtttgtgatcctggctggtagccatcggcagcacatgctcgccgtccaccatcacgataaagctcgcttcttcgccatcgaggaactcttcgataacgatgcgatgacccgcgtcgccaaaagcgttgcccgccagcatatcgtgaacagccgcttccgcttcttccagcgtcatcgccacgataacgcctttcccggcagccagaccgtccgctttaatgacgattggcgcgcctttctcacgcagatacgccagcgcaggttctacctcggtgaagttctggtattccgccgtagggatcttatggcgggccaggaaatctttggtaaacgcttttgagccttccagttgggccgcacctgcggttgggccgaagattttcagcccggcggcgcggaaggtatcgaccacgcctttcaccagcggcgcttccgggccgacgatggtcagatcaatcttttcgttttgtgcgaaatccaacagcgccgggatatcggtcacgccaatagcaacgttttgcagcgcgggttccagtgcagtgcctgcattacccggagcaacaaaaacagtctcaaccagcggcgactgggccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatagaaccgccaggctggattacgcaggtcacgcccgcagcggcggcggcatcaataccgtcgcggaacgggaagaacgcgtcagaagccatcgaggaacctttcacttccaggccttcatcggccgctttaataccggcgatttttgcggagtacacgcggctcatctggcccgcgccaatgccgatagtcatattgtttttggcatagacgatagcgttggatttcacaaacttcgccaccttccagcagaacagcgcatcacgcagttcctgttcgctcggctgacgtttggtcaccacgcgcagttcttccgcaccgaccatccccaggtcacgatcctgaaccagcagaccgccgttcacgcgtttgaaatcgaggcccggaacacgctcgccccactgaccgcaggtcagaacgcgtacgttctgtttggcggcggtgattttcagggcttcttcgctggcggacggcgcaataatcacttcgacaaactgacgagaaatgatggcctgtgcggtttccgcatccagctcgcggttaaaggcaatgatgccgccgaatgcggaggttgggtcggttttgtacgcgcgatcgtaagcatcaagaatggaattgccgatagccacgccgcaagggttggcgtgcttcacaatcacacatgccggctcggcgaactctttcacgcactccagcgccgcatcggtatcggcgatgttgttataagagagggctttaccctgaacctgggttgcggtagcaacggaggcttctttcacattctcttctatatagaaggcagcctgctggtggctgttctcgccgtaacgcatatccagcttcttaatgaagttcaggttcagcgtgcgtgggaagcgaccggcggcttctttgctttcaccgtggtaagccggaaccatgctgccgaagtagttggcaatcatgctgtcgtaggcggcagtgtgttcgaaggctttgatggcgaggtcgaaacgggttgcaagcgtcagcgatccttcgttgtcatccatctctttaataatggcgtcatagtcgctgctcttcaccacgattgcgacatctttatggttcttggcggcggagcgcaccatcgttgggccgccgatatcgatgttctcaaccgcatcttccagcgagcaaccttcacgggccacggtctgggcgaacggatacaggttaacaaccaccatatcgataggctggatctgatgttcttccataatggcatcgtcctggccgcgacggcccagaatgccaccatgtactttcggatgcagggtcttcacgcgtccatccatcatctccgggaaaccggtgtaatcggaaacttcggttaccggcagacctttttctgctaacagacgggcagtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgactgtggttaccgtgggcaaaatacagaaattacattgatgattgtggataactctgtgcgtaaaaaggtataaagcgggcttttgctggggaatgcagcagtcagtcatttttctgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgcgctaaagcgcgtcgcaactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaattagaaaaaccccggtccataaggccggggttttttgcatatcaattatttgcatgatgaagggaatctcatgtcagttctgtatatccaaattcgtcgtaatcaaattactgttcgcgatcttgaaagcaaacgtgaagtgtcaggagacgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcactggaaatgaatgagggcggtttgtcacaggttgaggaacgcattctccatgaagtggtcgctggggcaacgttaatgaaatatcgccagttccacatccatgcgcaatcagcggtactcagtgatagtgcggtcatggcaatgcttaagcagaaataatcgtgtcaccattggtgggtactaaacctgaagttcagcccaccgggatgagaaaaaatcgcctacgcccccacatacgccagattcagcaacggatacggtttccccaaatcgtccacctcagagcgtcccgtaaccttaaaacccaccttcttatagaacccaaccgcctgctcattttgctcattaacgttggttgtcagttccggtgccatcgagagcgcatgctccaccagcacccgacctacgccgcagccgcgcacatcaggatcgataaacagcgcatccatatgctgcccacttagcaacataaatccaaccggctgatcccgctcattaaccgcgacccacaacggcgcttccggcaggaaggaacgaactaggtcctccagctcggtccgatactctgctgatagaaaatcgtgagtggcatcgacagaacgacaccaaatcgcaacgagttcctccccttcctcatgccgtgagcggcgaatactaataaccattttctctccttttagtcattcttatattctaacgtagtcttttccttgaaactttctcaccttcaacatgcaggctcgacattggcaaattttctggttatcttcagctatctggatgtctaaacgtataagcgtatgtagtgaggtaatcaggttatgccgattcgtgtgccggacgagctacccgccgtcaatttcttgcgtgaagaaaacgtctttgtgatgacaacttctcgtgcgtctggtcaggaaattcgtccacttaaggttctgatccttaacctgatgccgaagaagattgaaactgaaaatcagtttctgcgcctgctttcaaactcacctttgcaggtcgatattcagctgttgcgcatcgattcccgtgaatcgcgcaacacgcccgcagagcatctgaacaacttctactgtaactttgaagatattcaggatcagaactttgacggtttgattgtaactggtgcgccgctgggcctggtggagtttaatgatgtcgcttactggccgcagatcaaacaggtgctggagtggtcgaaagatcacgtcacctcgacgctgtttgtctgctgggcggtacaggccgcgctcaatatcctctacggcattcctaagcaaactcgcaccgaaaaactctctggcgtttacgagcatcatattctccatcctcatgcgcttctgacgcgtggctttgatgattcattcctggcaccgcattcgcgctatgctgactttccggcagcgttgattcgtgattacaccgatctggaaattctggcagagacggaagaaggggatgcatatctgtttgccagtaaagataagcgcattgcctttgtgacgggccatcccgaatatgatgcgcaaacgctggcgcaggaatttttccgcgatgtggaagccggactagacccggatgtaccgtataactatttcccgcacaatgatccgcaaaatacaccgcgagcgagctggcgtagtcacggtaatttactgtttaccaactggctcaactattacgtctaccagatcacgccatacgatctacggcacatgaatccaacgctggattaatcttctgtgatagtcgatcgttaagcgattcagcaccttacctcaggcaccttcgggtgccttttttatttccgaaacgtacctcagcaggtgaataaattttattcatattgttatcaacaagttatcaagtatttttaattaaaatggaaattgtttttgattttgcattttaaatgagtagtcttagttgtgctgaacgaaaagagcacaacgatccttcgttcacagtggggaagttttcggatccatgacgaggagctgcacgatgactgaacaggcaacaacaaccgatgaactggctttcacaaggccgtatggcgagcaggagaagcaaattcttactgccgaagcggtagaatttctgactgagctggtgacgcattttacgccacaacgcaataaacttctggcagcgcgcattcagcagcagcaagatattgataacggaacgttgcctgattttatttcggaaacagcttccattcgcgatgctgattggaaaattcgcgggattcctgcggacttagaagaccgccgcgtagagataactggcccggtagagcgcaagatggtgatcaacgcgctcaacgccaatgtgaaagtctttatggccgatttcgaagattcactggcaccagactggaacaaagtgatcgacgggcaaattaacctgcgtgatgcggttaacggcaccatcagttacaccaatgaagcaggcaaaatttaccagctcaagcccaatccagcggttttgatttgtcgggtacgcggtctgcacttgccggaaaaacatgtcacctggcgtggtgaggcaatccccggcagcctgtttgattttgcgctctatttcttccacaactatcaggcactgttggcaaagggcagtggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagctatatcaaaacgttgaaaaactatcccgatcgcgtcctgccagacagacaggcagtgacgatggataaaccattcctgaatgcttactcacgcctgttgattaaaacctgccataaacgcggtgcttttgcgatgggcggcatggcggcgtttattccgagcaaagatgaagagcacaataaccaggtgctcaacaaagtaaaagcggataaatcgctggaagccaataacggtcacgatggcacatggatcgctcacccaggccttgcggacacggcaatggcggtattcaacgacattctcggctcccgtaaaaatcagcttgaagtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaacggctgtgtgccgatttatggcctgatggaagatgcggcgacggctgaaatttcccgtacctcgatctggcagtggatccatcatcaaaaaacgttgagcaatggcaaaccggtgaccaaagccttgttccgccagatgctgggcgaagagatgaaagtcattgccagcgaactgggcgaagaacgtttctcccaggggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccatacagtgcggaagatgtggtgaaattacgcggttcagtcaatcctgaatgcacgctggcgcaactgggcgcagcgaaaatgtggcgtctgctgcacggtgagtcgaaaaaaggctacatcaacagcctcggcgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcgggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttagtgccaactcaggaagctattcagaaactggtcgcggcgcgtctggcagctgacgtgacgggcgttccaaccctgctggttgcccgtaccgatgctgatgcggcggatctgatcacctccgattgcgacccgtatgacagcgaatttattaccggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaagcaacaacaaccgttgctgactgtaggccggataaggcgttcacgccgcatccggcaatcggtgcacgatgcctgatgcgacgcttgcgcgtcttatcatgcctacagccgttgccgaacgtaggctggataaggcgtttacgccgcatccggcaattctctgctcctgatgagggcgctaaatgccgcgtggcctggaattattgattgctcaaaccattttgcaaggcttcgatgctcagtatggtcgattcctcgaagtgacctccggtgcgcagcagcgtttcgaacaggccgactggcatgctgtccagcaggcgatgaaaaaccgtatccatctttacgatcatcacgttggtctggtcgtggagcaactgcgctgcattactaacggccaaagtacggacgcggcatttttactacgtgttaaagagcattacacccggctgttgccggattacccgcgcttcgagattgcggagagcttttttaactccgtgtactgtcggttatttgaccaccgctcgcttactcccgagcggctttttatctttagctctcagccagagcgccgctttcgtaccattccccgcccgctggcgaaagactttcaccccgatcacggctgggaatctctactgatgcgcgttatcagcgacctaccgctgcgcctgcgctggcagaataaaagccgtgacatccattacattattcgccatctgacggaaacgctggggacagacaacctcgcggaaagtcatttacaggtggcgaacgaactgttttaccgcaataaagccgcctggctggtaggcaaactgatcacaccttccggcacattgccatttttgctgccgatccaccagacggacgacggcgagttatttattgatacctgcctgacgacgaccgccgaagcgagcattgtttttggctttgcgcgttcttattttatggtttatgcgccgctgcccgcagcgctggtcgagtggctacgggaaattctgccaggtaaaaccaccgctgaattgtatatggctatcggctgccagaagcacgccaaaaccgaaagctaccgcgaatatctcgtttatctacagggctgtaatgagcagttcattgaagcgccgggtattcgtggaatggtgatgttggtgtttacgctgccgggctttgatcgggtattcaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgcttcaggaagcagcggaaaaaatcaccgatctcggcgaacaaattgtgattcgccatctttatattgagcggcggatggtgccgctcaatatctggctggaacaagtggaaggtcagcagttgcgcgacgccattgaagaatacggtaacgctattcgccagcttgccgctgctaacattttccctggcgacatgctgtttaaaaacttcggtgtcacccgtcacgggcgtgtggttttttatgattacgatgaaatttgctacatgacggaagtgaatttccgcgacatcccgccgccgcgctatccggaagacgaacttgccagcgaaccgtggtacagcgtctcgccgggcgatgttttcccggaagagtttcgccactggctatgcgccgacccgcgtattggtccgctgtttgaagagatgcacgccgacctgttccgcgctgattactggcgcgcactacaaaaccgcatacgtgaagggcatgtggaagatgtttatgcgtatcggcgcaggcaaagatttagcgtacggtatggggagatgcttttttgagtaaagcttccatataatttttctccgcaatgtatcgagggttatccgtaaagccaaagctttcagccatcttatttaatgtattaaggattaattcagcaataacccggtgaccaaattcaaaagccaactcaaaggcagagtatttttgtggggctttgtgttgccaaaaatccataatatcttcagcggtaaatccaaacaggcgtgcatggtcagataaagcaagataaaccgtctctacaacattttgttgtttatgctgtatcgctgaaaacaaaccgggatattcattagaattatttgccaggaggaggggcttcatattttttttatcgaatttaaacgtattaaacagagtgggtaatgcgttaaaaatagtattaataacgttcatgtgtccgcgctgcatggccataaacaaacccgtgtcgcgcgcaagacttttagcggtcagaagatctacaatatcggaagctgaaatgttaatttcctgggctaggctgggcaatgcttcaagaataactttcacgatatcgctatgtccattttgcatcgccagatatagtcctgggcaaccataaaaatcctttgccttcaggagatcgagtacctgttctttagtcaaatgacatgtgcgaattaacaaaggtaacgcgttcaaaacaattttcagcatgtcggcatcaccattcgccataacatggtataaaacatggctggacgttctatttttggcactcaggaatttatacacttgttcgttatctaaatgatgtgttgcggccagtttaggtaaggcgttcagaatcgaggttacaacatttttatccttacgtgatatcgctaaaaataatccagaaaaaccatttttatcttttgcctccagaatatgcatgagattttttttcgagagtaatccttcatatcctgtttctgacaatgaattgaaaatagtctcaacgatatccgcattaccataatttatagccaaatataaacctggcaggttaatactattataggcagtcaacatttctgttctatgtagttctggcattttctggagttgaatcatcagttgcgtaagttggtgattctgaccaattgccattagcaaattcatcgttgcaggtgataatggaggggttatttcatccacagatccttttaacatcaatagctgttctttcggaagtgctggaattattgcaacagattgattaataacatgatcatttgaccatttcaggaggctataatctacattcataaaatccatcagagaatagtgtttaatattctctttgctttcgctcataattcttattttatcgttagttacattaggatcataaaccgaaaccacgtaatgggtacatccttcagttgtgttctttattcttagccggaccgtcaaagcatggttatccaccagtaatatggctgccataacactgatgccatttgattccatcttgtcaaaatatgctttcataactagcccgaaatcaccgcaggcagcaacgcaacgcccctcaggacggctggaaaccaacgccaaagtctggtttttgcattttttgttgaagtgcgtgagaaatttttcagctgaagagtaatcatcttgatggggtttgtaatcaacattctgataaatatcattaatatattgtgcagcaatgtgtcggcatactatacggttttggggtcgccccggaaaataacattgaccattaagtttaattcttgggaattctttttcttttctatctgattttaggtttaattcttgtttatcaagagtgtctgagcgttgaggtaaaatttccattaggtatttttcaaatattggggcaatggtttgagtaagtgtcgtgttttcgtttttattaattatcgtaatttctttcttatcagcttgtaagacggacgtggaaaatttaatgacaaaatccttgttgctaaagatatgacgaccattttgtctacagttctctgagaagctttttaatagaggcgtcgccagctccttgccagaaaatttatcctcgagttctttataaaacaattcactcagggtttggtgttcatttgtctgggctgtattattaatatttgcagagaaagaactacgaggaatacgagtaatcatttaaatatctcattgtttattgatgtcttgaattttaactatcagaacagtgaaaaaatttaatatgattacaactaaagaaatatcataaatcgctcaatctcataatgcagccgtaaaagtttcggtggaatgagatcttgcgattttgttaataattaagtggtttgatgtttaaaaataatgctgagttaataaaagtgtgtgaagtgtatgacattaagttattttggcgtcaatgcgattaacagacacccttattctattgccactcaggtatgatgggcagaatattgcctctgcccgccagaaaaagtcagcgcattccaccgtacgccagcgtcacttccttcgccgctttaatcaccatcgcgccaaactcggtcacgcggtcatcggtaatacgtgaaatcggtccggaaatagaaattgcggcaaacggttcacggtgctcatcgaaaatacacgctgcaaggcaacgtagccccagtgcatgttcctcatcgtcaaatgaataaccccgtttgcgcgtttgggcgagatcttcttttaaatgcacaggagacaccagcgttgcgtgggtataggcatgtaaccctttgcggtgcagcagcttcgtcacctgttcttcgctcagttgggctaaaaaggctttacccgcaccggaagcgtgcatcggcaatttaccgccgataggcgcggacattcgcatcagatgcgtacactgtacctggtcgataataatcgcttcgtgatcgctttgatcaagcaccgccatattgaccgtttcgccagactcttccattagattgcgcaggatagggtgaacaatcgctaacaaattacggctctggagaaagctgctgccgaccataaaggcatgtgcgccgattgcccaatgtcccagttcgccaacctgacgcacgaaaccctgctgttgcatcgtggttagcaggcggtgggtcgtggaattgggtaacccggcttgttgcgccagttccgtgagtgccacactgccattggattcggcaatccactccagtaatttcaggccacgcgttaaagactgaacctgtccagtcgctggtgcggtggcaacggcgggttttctgccgcgtttcgcgggaatgggtgcgaccatgacagtctcttttttctgtatcgtggaaatcattttcatttttattgttagctaatgcaatagttactgaactgatccgatgagttaatgttgaacaaatctcatgttgcgtggtggtcgcttttaccacagatgcgtttatgccagtatggtttgttgaatttttattaaatctgggttgagcgtgtcgggagcaagtgtgagcagcaaagtggaacaactgcgtgcgcagttaaatgaacgtattctggtgctggacggcggtatgggcaccatgatccagagttatcgactgaacgaagccgattttcgtggtgaacgctttgccgactggccatgcgacctcaaaggcaacaacgacctgctggtactcagtaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcggcggcgaaactggcgcgagcttgtgctgacgagtggaccgcgcgcacgccagagaaaccgcgctacgttgccggtgttctcggcccgaccaaccgcacggcgtctatttctccggacgtcaacgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtatttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtcgcgcgtcaacaggtggaaaacggcgcgcagattatcgatatcaacatggatgaagggatgctcgatgccgaagcggcgatggtgcgttttctcaatctgattgccggtgaaccggatatcgctcgcgtgccgattatgatcgactcctcaaaatgggacgtcattgaaaaaggtctgaagtgtatccagggcaaaggcattgttaactctatctcgatgaaagagggcgtcgatgcctttatccatcacgcgaaattgttgcgtcgctacggtgcggcagtggtggtaatggcctttgacgaacagggacaggccgatactcgcgcacggaaaatcgagatttgccgtcgggcgtacaaaatcctcaccgaagaggttggcttcccgccagaagatatcatcttcgacccaaacatcttcgcggtcgcaactggcattgaagagcacaacaactacgcgcaggactttatcggcgcgtgtgaagacatcaaacgcgaactgccgcacgcgctgatttccggcggcgtatctaacgtttctttctcgttccgtggcaacgatccggtgcgcgaagccattcacgcagtgttcctctactacgctattcgcaatggcatggatatggggatcgtcaacgccgggcaactggcgatttacgacgacctacccgctgaactgcgcgacgcggtggaagatgtgattcttaatcgtcgcgacgatggcaccgagcgtttactggagcttgccgagaaatatcgcggcagcaaaaccgacgacaccgccaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaatgtggtcggcgacctgtttggcgaagggaaaatgttcctgccacaggtggtcaaatcggcgcgcgtcatgaaacaggcggtggcctacctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggcctttcggggcttatcacgccgtcgctggacgagatggttaacgtggcgaaagagatggagcgtcagggcttcactattccgttactgattggcggcgcgacgacctcaaaagcgcacacggcggtgaaaatcgagcagaactacagcggcccgacggtgtatgtgcagaatgcctcgcgtaccgttggtgtggtggcggcgctgctttccgatacccagcgtgatgattttgtcgctcgtacccgcaaggagtacgaaaccgtacgtattcagcacgggcgcaagaaaccgcgcacaccaccggtcacgctggaagcggcgcgcgataacgatttcgcttttgactggcaggcttacacgccgccggtggcgcaccgtctcggcgtgcaggaagtcgaagccagcatcgaaacgctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgtacccatgtgatcaacgtcagccaccatctgcgtcaacagaccgaaaaaacaggcttcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagagctgatccgcgaaaactaccagggcatccgtccggcaccgggctatccggcctgcccggaacatacggaaaaagccaccatctgggagctgctggaagtggaaaaacacactggcatgaaactcacagaatctttcgccatgtggcccggtgcatcggtttcgggttggtacttcagccacccggacagcaagtactacgctgtagcacaaattcagcgcgatcaggttgaagattatgcccgccgtaaaggtatgagcgttaccgaagttgagcgctggctggcaccgaatctggggtatgacgcggactgattcacaaatctgtcacttttccttacaacaaacagggcgctcaatgagtgccctgtctctttattaatatgaaacacttatactggaaacaggctggaataatcttagccggaaaaacgaatgtcaaaaggcacagtaaagatgccagtcagcgtgtttccggtcctttggtcattcaattgcttcaggaacatataacgataaggagaacctgaactcgtgttaacgctgcttcacctgctttctgccgtcgccctgctggtctgggggactcatattgttcgaaccggcgtaatgcgcgtcttcggcgcgcgtttgcgtactgtccttagccggagcgtcgaaaaaaagccgctcgccttttgcgcggggatcggcgttaccgcactggtacagagcagtaatgccaccaccatgctggtgacctcgtttgtcgctcaggatctggtagccctcgcaccggctctggtcattgtgctgggtgcagatgtcgggacggcgctaatggcgcgtattctcaccttcgacttatcctggctgtcaccgttacttatttttatcggcgtgatttttttcctcggacgcaaacagtcacgcgccgggcaactgggccgcgtcggtattggtcttgggctgattttgctagcgctggagttgattgtgcaggccgtaacgccgatcacccaggcaaacggcgttcaggtgatctttgcctcgctgaccggcgatattctgctggatgcgctgattggcgcgatgttcgccattatcagctactccagccttgctgctgtactgctgaccgcgactctgaccgccgcaggcattatctccttccccgtggcgctctgtctggtgattggtgctaacctcggttccggtctgctggcaatgctcaacaacagtgccgccaatgccgcagcccgccgtgtcgcgctgggtagtctgctgtttaagctggtgggtagcctgattatcctgccgtttgtccatttgctggcagagacaatggggaagttgtcattgccaaaagcggaactggtgatctatttccacgtcttctacaaccttgtacgttgcctggtcatgctgccatttgttgacccgatggcacggttttgcaaaacgattattcgcgatgaaccggaactggatacccagctacggcctaaacatctggatgtcagcgcgctggatacgcccacgcttgctctggcgaacgccgcgcgcgaaaccctgcgcattggcgacgccatggaacagatgatggaagggttgaataaagtgatgcacggtgagccacggcaggagaaagagctgcgtaagctggcagatgatatcaacgttctctacaccgccattaagctgtatctggcgcggatgccaaaagaagagctggcggaggaagagtcgcgccgctgggcagagatcatcgaaatgtcgctcaaccttgaacaggcctccgatatcgtcgagcgcatgggcagcgaaattgctgacaaatcactggcagcacggcgggcattttcgcttgatgggttgaaggaactggatgcgctctatgagcaattgctcagtaatttaaagctggcaatgtcggtgttcttctctggcgatgtcaccagcgctcgtcgtttgcgtcgcagcaaacatcgttttcgcattcttaatcgccgctattcccacgcccacgtcgatcgcctgcatcagcaaaacgtgcagagcattgaaaccagttcgctacatttaggcttactgggagatatgcagcgcctgaactcgctgttttgttcggtggcttacagtgtgctggaacagccggatgaagatgaaggacgggacgagtattaatattgtgaatcctgtaggcctgataagacgcgtcaagcgtcgcatcaggcactatgaacaagatgccggatcatgcatccggcaattcacttaaaaacggtgaccagcttccagcggaaccgcttcttcaccagccttaaacacataagtggtgttcgggccacccagcgtagcgtgacctttactcactgtgatccagttaccttccggtagaccaataatcgtcagttctggcgcgacgaccagcagttcgcgaatacgctgctcacgggtttcacctttatggccttccggcagcgcgttggtgaagtgcgggttgatttgcagcgggaacagatttagcgcatcgaaaccttgcggatcgacaatcggcatatcgttggtggtacgaatagttgggcaagcaaggttagcgcctgcgctccagccaatatacagagcgccacgtttaaccacgtcagtaattggtgccagcagcccgcgctcgcggcactgtttcagcaactggaaagtattcccgccgccgacaatcacgatctcagcattttcaatcgcggcaacgggatcgacaacgctatgaataccggtgacagaaacacccagcggagcgagaaccgcagccgttttcgctgtgtaatcatcccaggtctgcgttacgccagcgaaagggataaacaccgctgagcggcgaccctgcaactgttcagcaattagcggcagtgcatgttccagccaggctttacccggcagcgtcgagttactcaataaaagcagttccattacttctccggttagtaagaaatcacgggaggcatgctaccactgcgaatttaaccacttactgacatggctcacgatgtcgcacattgcttctggaaagtgatttgagcaggtaacgaattcaagccaatggaaataacaaatagttcgctcatgactattttttatcaacccaaaggtacggtatattccgttttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaacggtcagttgattgaacctcgggaagccgaagatttggtacttatcgccctgaacaagcccgttggtattgtaagcaccaccgaagatggcgagcgcgataacattgtcgatttcgttaaccacagcaaacgcgtgttcccgattggccgcctggataaagactcccaggggctgattttcctcaccaatcacggcgatctggtgaataagatcctgcgtgctggcaatgatcatgagaaagagtatctggtgacggtcgataaaccgattaccgaggagtttattcgcggcatgagtgcgggggtgccaatcctcgggacagtgaccaaaaagtgcaaagttaaaaaagaagcgccgtttgtcttccgcattaccctggtgcaggggctgaaccgtcagatccggcgcatgtgcgagcatttcggctatgaagtgaaaaagctggaacgcacgcgcatcatgaacgttagcttaagcggcattccgctgggggaatggcgcgatttaaccgacgatgagttaatcgacctctttaagctcattgaaaattcctcttccgaggtaaaacctaaagcgaaggccaaaccgaaaacagcgggcatcaaacgtccagtcgttaagatggaaaaaacggcggaaaaaggcggtcgcccggcgtccaacggtaagcgttttacctcgccggggcgtaaaaagaaggggcgctgattaacgcctcagactgatgaaaacggcccaaaagtgcccggacagtcccctcgccccttcgggaaaagggttagggtgaggggaaaattgtgttcacactgacgagtgaaaatctcaggcgttgattgtggattagcgcctgccgcgcgtcgacgtatttgctgaccagctaaatgacgcttcaggatccggtttataagcctgctttttcttcaactggcgggcttttttcgcttcagcctcacgctcaaccattaatttatcgatgtaatctttcttaatgctgttggtttcggagttggtcaatacgcgaccatgcgcaatccgcgcccgatccagcagtgttttaagttcacgctgctcgcgttcagtcatctctttttgggtaatacgggggagtgccatgatggtgccctcagtgagccagagagttcagtgtacgggaattcgtttgcgagcagaactgataatattcattttgccttctcttaactatttatctctttcgataattaattagagatgcagataaaaaaattaaaggcaattattctccgataaagacgctggttaacagagtacaggctcgtttattgatgagcatagtgacaagaaaatcaatacggcccgaaatatagcttccaggccatacagtatttactcaaacaaattactatgcagtttttgcaccacctgctcggcatcttcgccgggcaccaggaagcacaggttatggctggatgcgccataacaaatcatgcgaatgttgaacggttccagtacgccgaatacctctttgccaacgccgcaggcttttgacaggtcattgccaatcaacgcgaccagcgccagaccttcttccacctccacccgacacagtgcggaaagctccatcagcagagattgcgtcagcaacgtatcgccagtggaggttgaaccggtggtatcaagggttaatgccacgctcacttctgacgtggtgattaagtctaccgaaatattatgccgcgcgaggatgccgaaaacttccgcgaggaaaccgcgagaatgcagcatattcaggctgtgcaaagtgagcagagtctgattgcgacgaagcgccagagcgcggaacagcggcggattttcagttttattgcacaccagcgtaccacctgcgcgtgggtctttgctggagccgacaaagaccgggatatcgctgcgtactgcgggtagcaacgttgccggatgcagtacttttgcaccaaaagttgccatctctgccgcttcggcaaacgcgatttcatcaatgcgttttgctgcggaaactacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctaccgataaatccctgggtgatcactaagccttcattgagacgtgggagcagctgcagcgcggccagttccgccagcgcggctatatctggctctgcacgaccaaatcggtcgttggtacgcatcactttacgtacatcaaaccactgtgcctgaacatcgcgttcgcgcaggatctcaacaaacagcagggtcgacatcagctcgccgtggctgaccagctcatctgtcagcgccggagacgttgccagcgccgccgcttctgccagaacagtaatgttctccagcagacgttcaatctcttcacggataacgttcgggtaacgcagacgttccagaatggcaaactggatgttgcggatagcgtcgagtttttcgaatcgctcgccaggttccagtccttcagctaaagcgaccagcagattagtgataccagcagaagccgagaggacaactaaacgcacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtggccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcactgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaatcatcgtcgatatgtaggccggataaggcgttcacgccgcatccggcaaccgatgcctgatgcgacgcggtcgcgtcttatcaggcctacaggtcgatgccgatatgtacatcgtattcggcaattaatacatagcacgattgattaaataaccttaataacaatgccgacgttatgtcggcatttttttatcagataaatccccttgtctgtaatttaacggaaatcataccgtgaggttaatcctaaaatagatttttaatcgttgtttatttcggaaaatacgcagattaattgcttttgtttttattttaagtttatgatttttattgttatttaaatataagttgaaacttatatttgatattcattccaattatcctaaaacgccatcgctaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcagggtcggcagcaacgtcggtttcggcggggagttcctccgcgaccagcgtcagcaccgtaagctcggcggtgggtgtcgcgcttgcggcaaccggtggcggtgatggttctaataccgggaccaccacaaccacgaccaccagtacccagtaataaagtatgtatccccaaaataattcgagtcattgcatctgtggctagaagtatgaagggattaaccataaccacactccggtgtggttattctgcccctctggagaagagtcgtgaagcgacctgcactcattcttatctgcctgttattacaggcctgttcagccacgactaaagagctgggcaattcactgtgggacagtctgttcggcacgccaggcgtacagctgacggatgatgatattcaaaatatgccctacgccagccagtacatgcagcttaatggcgggccgcagttatttgtggtgctggccttcgctgaagacggacaacaaaaatgggtcactcaggatcaggctactctcgttacccaacatggccgtctggtgaagactctgctcggcggcgacaacctgattgaagtgaataaccttgctgccgacccgctgattaaacccgcacaaatcgttgatggcgcaagctggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattattttccggtgaaaaccactctcatcaaggcggcaaaacaatgattaaacaaactattgtcgcgttgcttttgagtgtgggagcgtcatcggtcttcgcggcaggaaccgtcaaggtgttcagcaatggcagcagtgaggccaaaacgctaacgggcgcagagcatttaatcgatctggtaggccaaccgcggctggcaaacagctggtggcccggtgcggtgattagcgaagagctggcaacggcggcagcattgcgtcagcagcaggcgttgctgacacggctggcagaacagggcgcagattccagcgccgacgatgccgctgcgattaacgccttacgccagcaaattcaggcgttgaaagtgacgggcaggcaaaaaatcaatcttgatcccgatatcgtccgcgttgccgaacgcggtaacccgccgttgcagggcaactacacgctgtgggtcggaccaccgccgtccacggtcacgttgttcgggcttatcagccgtcctggcaagcagccattcactccaggtcgcgacgtggcgagctatctctctgaccagagcctgctcagcggtgcggatcgcagctacgcgtgggtggtttacccggacggacgcacgcaaaaagcgccggtggcttactggaacaagcgtcacgtagagccgatgcccggcagcattatttatgttggcctcgcggactccgtctggagtgagacgcctgatgcccttaacgccgacattcttcagactctgacgcagcggatacctcaataatgaaaaaaagacatctgcttagcttactggcgctgggcattagcacagcttgctacggcgaaacatatcctgcgcccattggtccgtcgcagtcggatttcggtggcgtaggattattacaaacgcccaccgcgcgtatggcacgggaaggggagttgagtctgaactatcgcgataacgatcagtaccgttattactcagcttcagtgcaactcttcccgtggctggaaacaacgctgcgctacaccgacgtgcgcacccggcagtacagcagcgtcgaagcgttctctggcgatcaaacgtataaagataaagccttcgatctcaaactgcgtttgtgggaagagagttactggctgccgcaagtggcggttggtgcgcgggatatcggcggtacggggctgtttgatgcggaatatcttgttgccagcaaagcctgggggccgttcgattttacgctcggcctgggctgggggtatttgggcaccagcggtaatgtgaaaaatccgctctgttcagccagtgataaatattgctatcgcgataacagctacaaacaggcgggatctatcgacggtagccagatgttccacggtcctgcctcactgtttggcggcgtggaataccagacgccctggcaaccgctgcgcctgaaactggagtatgaaggcaataattatcagcaggattttgccgggaagctggagcaaaaaagtaagtttaacgtcggtgcgatttatcgcgttaccgattgggccgacgttaaccttagctatgaacgtggcaacacctttatgtttggcgttacgttgcgcaccaactttaacgatctgcgcccgtcttacaacgataacgcccgcccgcaatatcaaccgcagccgcaggatgccattttgcagcattcggtggtggcgaatcagttaacgctgttgaaatacaatgccggacttgccgatccacagatccaggcgaaaggcgatacgctgtatgttaccggcgagcaggtgaaatatcgtgattcgcgcgaagggatcatccgtgcgaatcggatcgtgatgaacgatctgccggatgggatcaaaacgatccgcattacggaaaatcgccttaacatgccgcaggtgacgacggaaaccgatgtcgccagcctgaaaaatcatctcgccggagagccgttgggccacgaaacgacgctggcgcaaaaacgcgtcgagccagtggttccgcagtccaccgagcagggctggtatatcgacaaatcacgctttgatttccatatcgatccggtgctgaaccagtcggtcggtggcccggaaaacttttacatgtatcagctgggcgtgatgggaacggcagatttgtggctgacggaccatctgctgaccaccggcagcctgtttgcaaatcttgccaacaactacgacaagtttaactacactaatcctccgcaggactcgcacttaccgcgcgtgcgtacccatgtgcgcgagtatgtgcagaacgatgtctatgtgaataacctgcaagccaactacttccagcatctgggcaacggcttctacggtcaggtctacggtggttatctcgaaaccatgtttggcggtgcgggggcagaagtgttgtatcgcccgctggacagcaactgggcgtttggtctggatgccaactacgttaaacagcgcgactggcgtagtgcaaaagatatgatgaaattcaccgactacagcgtgaaaaccggacatctgaccgcctactggacgccatctttcgctcaggatgtgttagttaaagccagcgtcgggcagtatctggcaggggataaaggcggcacgctggagatcgccaaacgctttgatagcggcgtggtggtgggtggctatgccacgatcactaatgtttcgaaagaggagtacggcgaaggggacttcaccaaaggcgtgtatgtctcggtaccgttggatctcttctcgtctggcccgacacgcagccgtgcggcgattggctggacgccgctgacgcgtgacggtggtcagcaacttgggcgtaagttccagttgtatgacatgaccagcgaccgtagcgtcaatttccgctaagtcatgggaaaggtgccagttttcgcactcactggcaccttcattcttaatggcctgtcgagccatcaggaacgcagttcactcccggtttgcgatctggtgtgtaaaggcgaaaacattctgtcttcctgtccgtcgatatcggttgcaggtctggttgcctgagcgactgggccatcattgggctggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacattgtcgatttttcgcgcattgctggtggctgggaatcacctgaatgggtgatttttgaattaccggctttggtgcggtttgtcttgccggatgcgccgccaggcgcggcttatccggcctacgggtaggtatatccggctttggtggaggcgcgctccaaatccaggttgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgctgtgcctcggcctgattttggttgtcttcctcggcaaagaaacggtgcatctggctgatgtgctgttcgcgccagaacaaaccagcaaatatgagctggtagaaggactggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggctgcgatcctgttactggtgatcaccctgtggctgtgtaattcgaaacggctgaagcgggagtaaaaagtcagcacgccgaaatggcgcggcgtgctggacaggaagattacagcgtagcagtttgttgtgttttcttcgtttccggttcccagagcgcttccagctcctcaagggttttacctttggtttccgggacaaatttccacataaacagtgctgccagaacgcccatacaaccgtaaatccagtaggagaaaccgttgtggaaatgggccaccagccaggagtttttgtccatcatcgggaaggtccaggagacgaagtagttcgccagccactgggccgccaccgcgattgccagcgctttaccacgaatagcattcgggaagatttccgacagcagtacccagcataccggaccccaggacatggcaaaggcggcaacatagaacagcatcgacagtagcgccacaatacccggtgcctgagtgtaaaacgcggtaccgaggctaaacataccgattgccattccgagtgcgccgataatttgcagtggcttacgaccaaatttatccaccgtcataattgccagaacggtgaaggtgaggttgataactccgacaataatggtctgcaacagcgcgatatccgtgctggcccccagcgttttgaacacttccggcgcgtagtacagcaccacattgatgccgacaaattgctggaagatggagagcattacgccgattacaatcacgcccacgccaaacatcagcagacgaccaccggttttgcggccatgatccagggagtgtttaatttcctgtactgcctgagttgcaagcgtgttgcccataattttgcgcaggataccttccgcctgttcttgcttgccgcgcgacatcagccagcgaggactttctggcacggtatacagcagcattaagaacagcagtgcagggatacattccgaggcaaacatataacgccagccgtcagtattcagccagctggcatcaccggaacgggcaataaaatagtttacgcagtaaactaaaagttgcccgaaaataatcgcaaactggttaaaagagaccagtttcccgcgaatatgagctggagccagttccgcaatatacattggcgagagcattgaggctaaaccaacgccaataccgccaataatgcgataaataacaaattccgggacataacctgccagataaacaggcacagtgttgtccgggtttatagaggtaaaaccaagttctggccaggcagaacctacaccagaaataaaaaacaggacagcagcaatcttaagtgaatcacgacgaccgaagcggttactgcaataaccaccgagggcaccgccgatgatgcaaccaatcagagcgctggccacgcaaaaccctaacagggagttggcagcggattcacttaagttttgtggagcaacaaagacggtattgagtgactcaacagtaccggaaataacggcggtgtcgtagccaaataataaaccacctaatgtagcgactaaggtaatcgaaaatatataactggaattatactgggtattcattcagacctgccttagaccattctgatcttttatcagtgcattgatgttggaattgtcaggcagttaaggcaattatcattttttacaatgcgtttacgtaatgtcttttctgtgatcttaattgtgataattatccaaaattgataaaaacaatactattgccgtgactcagagcacgaaagagaattatcgtaagtgggaaaacaaataacgtaaaaataataagctctatgatggaaatattaaccggcgaacgattcagattgcagacgaaagaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaacagcgacgcgaccggaacttcagtaatggcagcgataaacgacaggatgaataccaccgccagaatcggtactgacagcggcaacaggacaaggcggaaggcctgccacggtgtcgcaccatccagcgcagcagcttcttccagcgaactgtcgatggtttcgaaatagcctttgatggtccagacatgcagcgcaatcccacccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttcaacgctaaaacctaacgccagtttccagtgatcccaggagatttgctccgggatcaggctgccggtcgcaaagtttccctgacgcagcgagatagcgacgaccatcagcagcgggaacataatcgctgcgataaaaagtagcagtagcaggtgagtaataaataaacgagctttttgcgatttcggttggaccattgccatttttgttatctcccttaatcaaacttcattcgcgtggctttcaggttcactatcgccagcgcacccaccagcaggaagatcagcgtggcaattgctgccgccagaccgaagtcctgacccccgccgccttcaaaagcgatgcggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaacggacctgcgccatccattgctgaggcttcatacaaatcgtccggaatcgctttcagcaagcccatgcagaggatcatcatgtacggataacccagccaggtattgacgataattagcatcgtgcgggcggtggtcggatcgctgaaccaggcgggcttcacgccaaacagcgcgctcaacatcatgttgatttcaccgaagctctggttaaacaaccctttgaaaatcaagattgaaatgaacgatggcaccgcgtagggcagaatcagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatcaccccagttgccgtcggcggtaatggactggtaaaagccaatttggttattcggacgatatttcacgccgctctgattattcgtcaacgtgccgtcaccgtcgagtgtgtagagcggctgcgtgccagaaaactggcgcagggagctcatcatcactttgttgccatccggcagaatggcggtaatgtcactcagcgcctgacgattctgggtaatcacgcgcagattcgcgcgttcgccttcgggctgggcggtcgtttctttcagttgcagtttttgctcgccgccaaatttaaaagcgtcggagaggtaatttttgccggtttcgccgtcgctgagcgccagttgccactcatcgcccgccgggtaaagaccaaagttataggttttgcctgcttgccaggagcgatctaacaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgaactcaatatcagcgtggtaatggcgaacaggtattccccttgtgcgtacattaaaacaacaaggtaacccaccagcaggccgagcagacctagcactgaccatttcagcgcgtcgctttgccaccaatgtttctttttaatgacatccatggggttcttcctcattccaggacggataaggctttcacgccttatccgacaacaactgcctgatgcgacgctgacgcgtcttatcaggcctacatacgtttcggttttgtaggccggacaaggcgttcacgccgcatccggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttccatggtggcggcaatacgtggatctttcgccaactcttcctcgtaagacttcagcgctacggcacccagcggtttgtctttattaaccgcttccagaccttcatcagtcagcagatagttttcgaggaactctttcgccagctctttgttcggactggcggcgttaatacctgcgctcagcacgccaacgaacggtttggatggttgacccttgaaggtcggcagtaccgttacaccataattcactttgctggtgtcgatgttggaccatgcccacgggccgttgatggtcatcgctgtttcgcctttattaaaggcagcttctgcgatggagtaatcggtgtctgcattcatgtgtttgtttttaatcaggtcaaccaggaaggtcagacccgctttcgcgccagcgttatccacgcccacgtctttaatgtcgtacttgccgttttcatacttgaacgcataacccccgtcagcagcaatcagcggccaggtgaagtacggttcttgcaggttgaacatcagcgcgctcttacctttcgctttcagttctttatccagcgccgggatctcttcccaggtttttggcgggttcggcagcagatctttgttataaatcagcgataacgcttcaacagcgatcgggtaagcaatcagcttgccgttgtaacgtacggcatcccaggtaaacggatacagcttgtcctggaacgctttgtccggggtgatttcagccaacaggccagattgagcgtagccaccaaagcggtcgtgtgcccagaagataatgtcagggccatcgccagttgccgcaacctgtgggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccaccgtcgctttgtgtgatctctgttacagaattggcggtaatgtggagatgcgcacataaaatcgccacgatttttgcaagcaacatcacgaaattccttacatgacctcggtttagttcacagaagccgtgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaacatgtcatttggcctgaaactggctggcgcaaaaaaagaggtgattaaccaacgcgttaaccaggtggcggaagtgctacaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcgcaggttgggaaaccgctggagctgtaccactatccggcagaccgttttgtcgccggatttatcggttcgccaaagatgaacttcctgccggtaaaagtgaccgccaccgcaatcgatcaagtgcaggtggagctgccgatgccaaatcgtcagcaagtctggctgccagttgaaagccgtgatgtccaggttggagccaatatgtcgctgggtattcgcccggaacatctactgccgagtgatatcgctgacgtcatccttgagggtgaagttcaggtcgtcgagcaactcggcaacgaaactcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggttggacaggtagcggcggtgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcacaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagctggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacttgcgtgataactatcgtctggttgatggcgcatcgaaagacggctggttattcactgctgaacatactcagagtgtcctgaagggctttaacaagtttgttgttcagtacgctactgactcgatgacctcgcagggtaaagggctgtcgcagggttctggcgttgcatttgataacgaaaaatttgcctacaatatcaacaacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattaccctcgcacaacaatggcaggctggcgacagcatctggtcacgcccggctattcgtgtcttcgcaacctacgccaagtgggatgagaaatggggttacgactacaccggtaacgctgataacaacgcgaacttcggcaaagccgttcctgctgatttcaacggcggcagcttcggtcgtggcgacagcgacgagtggaccttcggtgcccagatggaaatctggtggtaatagcaaaacctgggccggataaggcgtttacgccgcattcggcaaccaacgcctgatgcgacgcttgcgcgtcttatcaggcctacaacggctgtcaaatgtaggccggataaggcgtttacgccgcatccggcataaaaacaggttgtcattatctgaaaggggcgaaagcccctctgattatcgggtttagcgcgctattgcctggctaccgctgagctccagattttgaggtgaaaacaatgaaaatgaataaaagtctcatcgtcctctgtttatcagcagggttactggcaagcgcgcctggaattagccttgccgatgttaactacgtaccgcaaaacaccagcgacgcgccagccattccatctgctgcgctgcaacaactcacctggacaccggtcgatcaatctaaaacccagaccacccaactggcgaccggcggccaacaactgaacgttcccggcatcagtggtccggttgctgcgtacagcgtcccggcaaacattggcgaactgaccctgacgctgaccagcgaagtgaacaaacaaaccagcgtttttgcgccgaacgtgctgattcttgatcagaacatgaccccatcagccttcttccccagcagttatttcacctaccaggaaccaggcgtgatgagtgcagatcggctggaaggcgttatgcgcctgacaccggcgttggggcagcaaaaactttatgttctggtctttaccacggaaaaagatctccagcagacgacccaactgctcgacccggctaaagcctatgccaagggcgtcggtaactcgatcccggatatccccgatccggttgctcgtcataccaccgatggcttactgaaactgaaagtgaaaacgaactccagctccagcgtgttggtaggacctttatttggttcttccgctccagctccggttacggtaggtaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctgggatcgacatctgcccgttccacctttatcagcagtgtaaaaggcaaggggtaattacgccccacagtgctgattttgcaacaactggtgcgtctcctggcgcacctttttttatgcttccttcctgggatatgagcgattttttatagtaactcacttcttcttcactaagaatatccattatctcaatgccttatcagagattcttttcctttcgccggtagtgtctggacattcaggctacttttccaggttattttatttctgttatgcagaggttttatgataagtcatatcctaaattctggcggcaataactctttgatgaaacatgatgtggtgcaaggaaataatatagtagatcttgatttactacgtaatttaaatggggtgccaggtttaaacagagataactttatttatatcagcaatattttttcaaatataaaacaacggaacgaaaaaatcatgcaataaatatgtttcgtgaagtctcaatcagtaatgatactataagtgtaaaattctacagaaatgaaaaaaattgaatgcgcttgcaattttctgatggataaagatgcgcaggggtatatcgacctgtctgatttggatttaacaagttgtcattttaaaggtgacgttatatcgaaggtgtcttttttatcatcaaatctacaacatgtaacattcgaatgtaaagaaattggggattgcaattttactactgcaatagttgataatgtcatatttagatgtcgacgtttacacaatgtgatttttatcaaagcgagtggtgaatgtgtcgatttcagcaaaaatattcttgatacagttgacttctcgcagagtcaacttggtcatagtaattttcgcgaatgtcagattagaaattcaaacttcgataattgttatctttacgcttcgcacttcaccagagcagagtttctgtctgccaaagaaatatcatttattaaatcgaatttgacagctgttatgtttgattatgtgcgaatgtcgacagggaattttaaagattgcattacagaacaattggaattaactattgattattcagatatattttggaatgaagatctcgatggttatatcaataacattataaaaatgattgatacattgccagataatgcaatgatattgaaatccgttctggccgtaaaactggtgatgcaattaaaaatacttaatattgttaataaaaactttattgagaatatgaagaaaatatttagccattgtccttatataaaagatcccattatacgcagttatatccattctgatgaagataacaagttcgatgattttatgcgtcaacatcgattcagtgaggtgaatttcgatacccaacagatgatcgattttattaacagatttaatacgaataaatggctaattgataaaaataacaatttttttatccaacttatcgatcaggccttacgatcaacggatgatatgatcaaagcaaatgtttggcatctttataaagagtggattcgtagtgatgatgtttcacctatatttatagaaactgaagataatttaagaacctttaacacgaatgaattaacacgaaacgataatatctttatcctgttctcctcagtcgatgatgggccagttatggtggtaagctcccagcgcttacatgatatgttgaatcctacaaaagataccaattggaattccacgtatatctacaaatccagacatgagatgttgcctgttaatcttactcaggaaacacttttcagctccaaatctcatggtaaatatgcgcttttccccatttttactgcgagttggcgagctcatcgtataatgaataagggtgtttaagtaaaggaaaacatcaccgttcctggcatcctggacggtgatgcccctacggttgccctcgccagcacgggcatcggtaaagcgtaaggttcaacatcgttttaccacttcatgcgattgttgcgtttttgttgcgtattagatcacttaatttgctttacatctcccgtaaacacttttctgcgatacaatgcctttacgttatgtaacggagagttcggcatgtcacaccccgcgttaacgcaactgcgtgcgctgcgctattgtaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccgggctgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggtgtctggctgatgcgcgctgccggatgtgtggtgaatgattatgctgaccgcaagtttgatggtcatgttaagcgcacggcgaaccgaccacttcccagcggcgcggtaacagagaaagaggcgcgcgcgctgtttgtcgtgctggtactgatttcgtttttactggtgctgacgctgaatacgatgaccattctgttgtcgattgccgcgctagcgctggcgtgggtgtacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttcggccaatacgataaattgattattggtattttgcagattggcgtactggcactgatggcgatcatcggtgagttaaatggcttaggctggggatattactggtcaattctggtggctggcgcgctgtttgtttatcaacaaaaactgattgccaaccgcgagcgtgaagcctgctttaaagcatttatgaataataactatgttggtctggtactatttttagggctggcaatgagttactggcatttctgatgatgtaaaaaagccggatgatcatccggctttcttctgggttgcctgatgcgcggcgcttctcaggcctacacaacacatcgcaatttattgaatttgcagattatggaaggccggataaggcgttttcgccgcatccggcaattctctctgattacccttcgccctgcgtcgcactctcaatcgtcaaacgcacgtctgatgtaatcaactccgccagcaactgataaaccttcatcgtttctgccggttcggcatcgccgctatcgctgatatacccttcatcacgcagtgtcagcaccagagaactgaacaccgccttgtcgaagaactccggcgcgttgatgccgtgcagcacggagagacgttgcgcgacggtgcggctctctttctccagcgtaccgcggttgatcgacgggttggcactcaacaaccagaaggtgatggcataacgttgcagcgtttcgcgcgcgcctgcggccagcagctgtagcgtgcgagaatgcgccgggttgatatgcaactcatcatcttgcagggtaatcagcccctgacgttgcatctcatttgccagcgcatcaataacgtccggcaactcgtcgcgatcccagcgcaggaacagctccgctttcagcattgggtaaagcacattgacgtgctccatcaatacgtcgcgggagatgtggcgatgctgggtgacgattgccgccatcagcgaaggcagcaccaacatatgcgcaatgttgttgcgatagtaggtcatcagcaccgcttgctcgcgcggcagaatgatgatgtcgccgattgtgtctttctcgacttcaaacttgttcatttgcagcgcgtgatcgataagctcgctggcgctggctgaaggaacggtagagtccgtggagtagggcacgttgcgcatcagatccaggtagcagttgagttgctcggttaactgctcgcgggtgagtgagcgctgacgtgatgccagtagcgcagtacagcacaggttcatggcgtttgccgcgcctgcgttgttaatgcgtaccatcagatcggcagcaatattattgaccgtcggcgttaaccatgccggacgcaccgcttcgatgggatcgatagattcacgccagtcaggtacatgctggttaaggtaggtcatcaacggcattggttcaccgaagttgacgtaaccctgaccgagattacgcagcttgcttaaaccgcgcagcatctgcggcaggctctctttctctttcgtcgcgccgcgcagttctttggcgtaagtacccacttccatgacgtgctcataaccgatatagatcggaatcagcgtaatcggacgcgtgccgccacgcagcatcgcctgaatggtcatcgacagcgtaccagttttcggatccagcaaacgccccgtacgggaacgaccgccttccacgaagtactcgacggaataaccacggctgaacagttcgccgagatactcccggaaaacggtggaataaagtttattgcctttaaacgtacggcgaataaagaacgcccccagacggcggaaaatcggcccggcaggccagaaattcaggttgatcccggcggcgatatgcggcggcaccagcccctggtgatacagcacgtaagaaagcagcaggtagtccatgtgactgcggtggcaaggcacatataccagctcatgaccgtcgtgggccagctggcgaacgcgctcagcgttatggacgttgatgccctggtaaagtcggttccaggtgaagcccagaatacggtcagtcaggcgaatcatctcgtaagagaaattcgccgcaatctcttccatcagtgcaatcgcgttctgctgcgctttttcatgggagatttttttgctgcgcgcttcatcttctaccgctttggcaatggcgcgggaggcgagcagcttattaaacagatcctgacgagcaggcaaacgtgggcctacggcagccagacgttgacgggcaaagtgcatacgcgccacgcgcgccagtttctgagcgatagttttatccgtgccgtgttcatccgccatacggcgcagcgaaactgacggcgagaaacgcacaaaactgtcgcgaccgagccacagtacagcgaaaaatttctgtacgccgttaagcatacgcagcggcgggttcacttcgcctttttcacgccccggcgcgcgaccaaacatcaccgacactggcaccatctgcacatccagatttgggttgctacggtgcaaatcgagatagtcgtggaacagcttaatagactcttctttcggcgtgtaataggtgaacacacgcggcccgccgtgaatgaacacatagcgcggcagtagcgtgccgtcgatttccagcggctctaacgggtcaggcaagtcatgtgccagacactgggcgcgcaacgtcagcaaatctgctttcgagttgtacggtaaaacgtacataattggacgagaggtatccagccccagttccggggcaggatctgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgctacgcaaacccgaatcatcggatttaacggtacactgatattgacgctcataatgtaaaaaggttctttcaatggccaataataccactggattcacccgaattatcaaagctgctggctattcctggaaaggtttacgcgctgcatggatcaacgaagcggcattccgtcaggaaggcgtagcggtattgttggcggtggtcatcgcctgctggctggatgtggacgcgattacccgcgtgctgcttatcagctccgtgatgctggtgatgattgtggaaatcctcaatagcgccatcgaagcagtggttgaccgaattggctctgaataccatgagctttccggacgcgcaaaagatatgggatccgctgcggtgctgattgccattatcgtcgccgtgattacctggtgcattctgttatggtcgcattttggataacccttccagaattcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgttgaccttcgtcagcagagcttcaccattgaagggctggcggttggggttattcgcaacggcgactggctgtaacatatctctgagaccgcgatgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagcccggtttatttgggcggcgtggcggttggtgcaacggcgaccagctttctctttatgctgttgctgtttttacgcatgagcaccaccgggctgactgcgcaggcttatggtgccaaaaatcctcaggcattagcccgtacgctggtgcaaccgttgctgttggcgttgggggctggggcgttaattgcgctgctgcgtacgccgattatcgatctggcgctgcatattgttggcggtagtgaggcagtcctggaacaggcgcggcgctttcttgaaatccgctggttaagcgcaccggcgtcgctggcgaatctggtattactcggttggttactcggcgtgcaatatgcccgtgcgccagtaattttgttagtggtcggcaatatcctcaacattgtgctggatgtctggctggtgatggggctgcatatgaacgtgcagggcgcggcgctggcgacggttattgcggaatatgcaacattgctgattggtctgctaatggtgcgtaaaatcctcaaactacgcggaatttccggcgaaatgctgaaaactgcctggcgaggaaacttccgtcgcttgctggcgcttaaccgcgatatcatgctgcgttcgctgttgttgcaactctgtttcggcgcgatcaccgtacttggcgcgcgactggggagtgacattatcgctgttaacgcggttctgatgacgctactcacctttaccgcctatgcgctggatggttttgcctacgcggttgaagcgcactccggtcaggcatacggtgcgcgcgacggtagccagttgctggatgtctggcgggcagcgtgccgccagtcggggatcgtagcgttactgttttcggtggtttatttgctggctggggaacacatcattgcgttactgacgtcgttaacccagattcagcagctggctgaccgctatcttatctggcaggtgattttgccggtggttggcgtctggtgttatctgctggacggcatgtttataggcgcaacgcgtgccaccgaaatgcgtaacagtatggcggtggccgccgcaggttttgcgctgacgctccttacgctgccgtggctgggtaatcatgctttgtggctggcattaaccgtctttctggcgttgcgcgggctttctctggcggctatctggcggcgtcactggcgcaatggtacctggtttgccgcaacgtgacggttaaaaattctgaataaataatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggtaaacgtgatcaactggtcggtaaaatccaggaacgttatggttatcagaaagatcaggcagaaaaagaggtcgtggattgggaaacccgcaatgaatatcgctggtaattaatccctcctgcccgacgtgtacaaggatgtacgccctcttaacgcggtttctttttcacctgcacagagtgatcatgctggcactgttcaggatgacgacacgcttccacttctacacatgccgcacagagcccatgtgcttcaatcacattatgccgcagggcaaaccccatttttgccgccagcgtatgcataatgtcttccacgccttctgcacactcttctttcactgcgccgcagcgatcgcaaataaacatggctgacgtatgggtgggctgatcgaacagatgacagagcacataactgttggtggattccaccttatgcacaaaaccttgctcaagcagaaaatccagcgcgcgataaaccgttggcggcttggcttgcggttcagcttcgcgcagtaaatcaagcagatcataagcgctgatagcgccatcctgcagactcatcaggcgcaacacttccaggcgctgtggggtcaggcgcacattacgctgcgcgcagattttttcagcctgcgctaataactcctgcgttgtggtcttttccatcgggcacctcaaagtgggggttaagaatgtccttactttaccatgttccaggaaaaacaccgagaacccttattgttgccgtaatgttgattttctgttttgtaggtaaggtgttatgttgccttgtcgtaccattatcaacacgataataattaataattcatttttaaataaattgcttcaagttaactcgctatttatttaactgggtttaaacgcatacctgtagttcagaaattatgagcgatttttgatagtgaccagatggcaaaagaattataaggaggacacggtacgacaaaaaaggtagatgaatcatgttgaagataatacccggtgcaactggatactttaataaaacactcaattcaaatcaattcgataatgaagatgcaatcaaagataaattagataatagaggttcaatcaaaggtaaattaaataatatatatggtaaatctattgattatgcagcgctgcgtcatcgggatataattattgcaaaaatagatttgtttattcaacgaatcacgcataatttatggcatgcacgtaaaaaaatgtgtttttaattgtgcaaataaatgatctcaaaatgtgggtcaataagtatattgacgattgcactgatgaggatttaaacgatcgtgactttattgcatcagttgttgaccgggctatttttcatttcgcgattaatagtatatgtaatcctggggataataaagatgcaatgcccattgaacaatgtacttttgatgtagaaactaagaatgaccttccctccacggttcagctattttatgaggaatctaaggataatgaacctttagcgaatatacattttcaagcaataggttctggttttttaacgtttgttaatgcctgccaggaacatgatgacaacagcttaaaattatttgcttcgctgttaatttcactttcatattctagtgcctacgcagatttatcagaaacagtgtatattaatgaaaataatgagagctacctgaaagctcagtttgaaaaattatctcaacgtgatatgaagaagtacctgggagagatgaagcgtctggctgatgggggagaaatgaattttgatggctatctggataagatgtcacatctggtgaatgaaggaacgctcgatcctgatattttaagcaaaatgcgagatgctgcaccacaattaattagcttcgcgaagtcgtttgacccaacctcaaaggaagagattaaaatacttacagacacttctaaattaatttatgatttgttcggggttaaatcggagaaataatatgtgaagttcttcgatagtatggaaggcattatataaaaggacccaatatttattgggttcttttttctctatcaatactattagcagggagatatatcaccagagtttaatgtgtgattttttatttatcgtcgaacctggattgtttatcattggccttaacaaagttaacggctaataagattatttccatcacttcgtgagagcttcatgccttgagaggatctcaattttcttttgcaatgagacaggcgcttcctgttgttatggtatagtaccccgctattgagcctcctgaatagtgatgctgaataacataaccccatgatatatcgataaaataatctctacatttgaaaatgcacggtaattctgaaatgcaaaaaatcaaccaaaccagcgcaatgcctgaaaaaactgacgttcactggagtggtcggtttagcgttgcaccaatgctcgactggacggacagacattgccgctatttcttgcgtctgctttcccgcaatacgttgctgtataccgaaatggtgaccacaggggcgattattcacggtaaaggtgattatctggcgtacagtgaagaagaacatccggtagcgttgcaactgggcggtagcgatccggcggcgctggcgcagtgtgcaaagctggcagaagcgcgcggatatgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgacgaccaggacagctatgaatttctctgcgatttcatcaataccgtttccggcaaaggcgagtgtgagatgttcatcatccacgcacgtaaagcctggctttcggggttaagcccgaaagaaaaccgtgaaatcccgccgctcgattatccgcgtgtgtatcaactgaagcgtgactttccgcatctgacaatgtcgattaacggtggtatcaagtcgctggaagaggccaaagcacacctgcaacatatggatggcgtgatggtcgggcgcgaggcgtatcagaatccgggtattctggcggcggtagaccgggagatctttggttcctcggataccgatgccgatccggtggcggtagtgcgcgccatgtatccgtacattgagcgtgaactcagccaggggacgtatctcggccatattacccggcatatgttgggcttgttccagggtattcctggcgcgcggcagtggcggcgttatttaagtgaaaatgcccataaagcgggtgcagacattaatgtgctggaacacgcgctcaaactggtggcggataagcgttaacttttcaccaaaaagtagtcaaattcaccacgccctgcgcaccgtcgcggggcgttttgctgttaaatcaatagattatttttggcatgattcttgtaatgccagcaagagatttcatatttgggagagcatcatgctggaactactttttgtgattggcttttttgtcatgctgatggtcaccggcgtttcgttgctgggcattatcgccgcgctggttgtggcgacggccattatgttcctcggcggtatgctggcattgatgattaagttgctgccgtggttactactggcgattgcggtggtgtgggttattaaggcgattaaagcaccaaaagtgccgaaatatcagcgttatgaccgctggcgttactaagggattgtgcggatgatcacaacctaaggttttatccttagaacaaaataggaattgataatcaaatctgtcactattgcgcctctaacagattcatcgtgctgtaccctacatacagccgaactataaaaagaaagggcttcccaggtggaagccctatttcttttatggaatcagcaggctggaaccttgcgtcgcccggctttccagaatctcatgcgcacgctgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttttgattgagaatgcctaagttcacaccggtaaccgcacctgatgagttgccaaaactgaccattaagccgcggcgttgcaggcaatccagcgaccgttcccaggtgtctctgcccacggaatcgtacaccacgcgcactttcttaccgccggtgatctcttttaaccgctcgaccagatcctcttcacgatagttaataacctgccacgcgcccgcttttagcgcgctctgcgctttttgcgcggttcctacggtgccgataagtttcgcgcccagggcttttgcccactggcaggcaattaagccaacgccgccagccgctgcgtggaacaggaactgttcatcgggtttaatttcataggttttgcgcagcagataataaaccgttaagcctttcaggaaggatgccgcagcttgctcaaaagaaattgccgcaggcagaatcgccgctttatccgcaataatgttatgcacagagctgtaagcgcctaacgccgactgcgcatagactacacgatcgcctgccttaatatgctttacaccactgccgactttactcacgatgcctgctgcttcggtgcctaatccgctgggtagcgatggcggcgggtaaaggccgctgcggatatatgtgtcgataaaattgatgccgatggctttattttcgacctggatttcattctccgccggatcggcaggagtgaactctacggcttgaagtacttccgggccaccgtgcttgtgaaattcaattcgtgttgccatgtgtcctccagaacgtatcgtcagggtctgcttcatatgataaagtttcgacccattctttatctcggtaactccattcactatggcaggaaataaacccttcaacaaacagcaggctgaaccccgcgaacgcgatccacaagttgccgggctgaaagtgcctccgcactcgatcgaagcggagcagtcggtgttgggcggtttaatgctagataacgaacgctgggatgatgtagccgagcgtgtggtagcagacgatttttacacccgcccacaccgtcatatctttactgaaatggcgcgtttgcaggaaagcggtagccctatcgatctgattactcttgcggaatcgctggaacgccaggggcaactcgatagcgtcggtggttttgcttatctggcagagctgtcaaaaaatacgccaagtgcggctaacatcagtgcctatgcggacatcgtgcgtgaacgtgccgttgtccgtgagatgatctcggttgcgaatgagattgccgaagctggttttgatccgcaggggcgtaccagcgaagatctgctggatctggctgaatcccgcgtctttaaaattgccgaaagtcgtgcgaacaaagacgaagggccgaagaacatcgccgatgtgctcgacgcaaccgtggcgcgtattgagcagttgtttcagcagccacacgatggcgttaccggggtaaacaccggttatgacgatctcaacaaaaaaaccgctggcttgcagccgtcggatttgatcatcgtcgccgcgcgtccgtcgatgggtaaaacaacatttgcgatgaacctcgtcgaaaacgcggcgatgttgcaggataaaccggtacttatcttctcgctggagatgccatcagaacagatcatgatgcgttctctggcgtcgctgtcgcgcgttgaccagactaaaatccgtaccgggcagctcgatgacgaagactgggcgcgcatttccggcaccatgggtattttgctcgaaaaacgcaatatctatatcgatgactcctccggcctgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctctcgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacacaaatgcaagcggcaactgttgtgattaaccgccgcgctctgcgacacaacctgcaacgtcttcgtgaactggcccctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtactgttactcgaaggcttttttgatgccagagatctgccgacgatttctgcgcaacattttcataccgccgtgcataacgaagaacagctggctgcgctggaagaggctagcctggacgagccggttaccgtctggatgaaactcgataccggtatgcaccgtctgggcgtaaggccggaacaggctgaggcgttttatcatcgcctgacccagtgcaaaaacgttcgtcagccggtgaatatcgtcagccattttgcgcgcgcggatgaaccaaaatgtggcgcaaccgagaaacaactcgctatctttaataccttttgcgaaggcaaacctggtcaacgttccattgccgcgtcgggtggcattctgctgtggccacagtcgcattttgactgggtgcgcccgggcatcattctttatggcgtctcgccgctggaagatcgctccaccggtgccgattttggctgtcagccagtgatgtcactaacctccagcctgattgccgtgcgtgagcataaagccggagagcctgttggttatggtggaacctgggtaagcgaacgtgatacccgtcttggcgtagtcgcgatgggctatggcgatggttatccgcgcgccgcgccgtccggtacgccagtgctggtgaacggtcgcgaagtaccgattgtcgggcgcgtggcgatggatatgatctgcgtagacttaggtccacaggcgcaggacaaagccggggatccggtcattttatggggcgaaggtttgcccgtagaacgtatcgctgaaatgacgaaagtaagcgcttacgaacttattacgcgcctgacttcaagggtcgcgatgaaatacgtggattaatcgttctgtaatatttgattgtctgtgccggatgcggcgtgaatgccttatccggccaataaaatcctaaaaattcaataagttgatgttctttcatgctcttataaaggtcgtgcctctggcggatgtacgtttgtcatgagtctcactctgttgctaattgccgttcgctcctgaacatccactcgatcttcgccttcttccggtttattgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaatgcaggaaagcaggctggagctacccagcctgcagtgaaattaaactgtcgtcgctttcactctttctttatagatgatttttttgatgccatcgttctacgtgagagataataaacgttgttagttcttttattgttaagcttatcccaattatctggaattccttatcctgtttttttgggtggagtaataatttctgcacatctaaccattattaaatttaataataagtatcgggtttgttacgatagaatatttctatatcctcaagaatatgctttgccttattgcctgtgactttctgagattcaattatagtatcgttaaattctaatgttaaagagaactcttttttccgctttgtgtaagtttaaccttatattgattaccaatatcaaataaaaaggtcctgtaatgagaataatcacctttaacctcctcggcaaaacagcaaagcgtgcaaatatacataaagtctttcttacccctgattttgttaactaaatcaataaatgcgtgaaaaactttacttgcaatagaacttgatacttcttctccaggtctaaaaaatcttttgcaatttttaactgtgtttctatgtataaaaagaaatctttggcataagagatatctttattatttagtgcatctagctcaacaggtaaagatgtcgttttgttgctattcacatatgatatattcatatcatcatctccatcgcgagtaataaaattaatcaccattgtagggtagggggctggtcaatcagaaatcatctttataaacttcgattgtttttgtaatgctgtatcattaagttcattaaatcgtacagcagataaatgttctatcaaatttcgctcatttgccgaggattcatcataataaacgtaaaattaatgtatccttacatcgagtaataaacattttttatacaaaaaaagacaggaacgtatttactgggttaaatataatcatcctgcttttcatcacaaaaaccgcagataatccttcctttccccggcagctggcgttatggtcagatggtttttgcaacaaatctcacaataaaaagtttcaacatactgactatttagggaaaaatatgcgcaagatcacacaggcaatcagtgccgtttgcttattgttcgctctaaacagttccgctgttgccctggcctcatctccttcaccgcttaaccctgggactaacgttgccaggcttgctgaacaggcacccattcattgggtttcggtcgcacaaattgaaaatagcctcgcagggcgtccgccaatggcggtggggtttgatatcgatgacacggtacttttttccagtccgggcttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgccaccaacatgaatccggtgatctttgcgggcgataaaccagggcaaaatacaaaatcgcaatggctgcaggataaaaatatccgaattttttatggcgattctgataatgatattaccgccgcacgcgatgtcggcgctcgtggtatccgcattctgcgcgcctccaactctacctacaaacccttgccacaagcgggtgcgtttggtgaagaggtgatcgtcaattcagaatactgacagagcgggagagcgtgatgctctcccgaatgctgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggcttactgcatctgttgctgcaacatacctccgcctctctgacacttaatgagaactgcgatcccaccgtacgccacgacatggagcgttttttcctccgcaccgttcccgacaacggaaattatgagcatgactatgagggagcagacgatatgccttctcatatcaaatcctcaatgctgggaacatcgcttgtattgccggtgcataaagggcgtattcagaccggcacctggcaaggcatttggctgggggaacatcgcatccacggcggatcgcgtcgcatcatcgcgacactacaaggggagtaaaaaatgaccatttcggagttgctacaatattgcatggcaaaaccaggcgcagaacagagcgtgcataatgactggaaagcgacgcagatcaaagtggaagatgtactgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccagattcgcaaatctattatctggtggatgcgtcttatcagcaggcggtgaatttactgccggaagaaaaacgtaaattgctggtgcaactctgaaaggaaaaggccgctcagaaagcggccttaacgattacagcatcggcttaaggaagcgtgccgtgtgtgatgcttcgcactccgcgacggtttctggcgtaccggagacgaggatctcgccgccaccactgccgccttctggtcccaggtcgacaatccagtcagcggttttgatcacgtcgagattgtgctcaatcaccacaatggtgttgccctgatcgcgcagtttatgcagtacgtcgagcagttgctgaatatcggcgaagtgcagaccggtggtcggctcgtcgagaatatacagcgtctgcccggtgccgcgttttgacagttcacgcgccagcttcacgcgctgggcttcaccgcctgaaagggtggttgcggactgccccagtcgaatgtacgtcaggccaacgtccatcaacgtttgcagcttacgcgccagtgcaggtacggcatcaaagaactcacgcgcctcttcgatggtcatatccagcacttcgtggatggttttgcctttgtacttaatctccagcgtttcacggttatagcgtttacctttgcactggtcgcacggcacgtagatatccggcaggaagtgcatctccactttgatcacgccatcgccctgacaggcctcgcagcgtccgccacgaacgttaaagctgaaacgtcccggcgtatagccgcgcgcacgggattccggtacgcccgcaaacagttcgcgcacaggcgtaaacacgccggtataggtcgccgggttagaacgtggagtacgaccaattgggctttggtcgatatcgatcactttatcgaaatgctccagcccctgaatatcgcgatacggtgctggttcggcgatggtcgccccattcaactggcgttgggcaatcgggaacagtgtgtcgttaatcagcgtcgatttaccggaacctgaaaccccggtgatgcaggtaaacagacccaccggcagcgtcagcgtcacgtccttcaggttgttgccgcgtgcgcctgtcagcttcagcactttttccggattcgccggaacgcgtttcttcggcacttcaatcttgcgtttgccgctcatgtactgcccggtcaacgactccggcaccgccataatcgcttccagcggaccttctgcgaccacttcaccgccgtgaacacctgcgcccgggccaatgtcgatcacatggtcagcggcgcgaattgcgtcttcgtcgtgctccaccacaatcacggtattaccgagatcgcgcagatggataagcgtacccaacaggcgctcgttatcacgctggtgcaggccgatagacggctcgtccagcacgtacataacgccaaccaggcccgcaccaatctggctcgccagacggatacgctgtgcttcaccgccagaaagcgtttctgccgagcgggaaagcgtcaggtaattcaggccgacgttaacgaggaatttcagacgatcgccgatctctttaaggattttttctgcaatcttcgcccgctgacctgcgagtttgagattgttgaagaattccatcgcatgaccaatgctcatgtcggagatagcaggcagcggcgtattctcgacatacacgtggcgcgcttcccgacgcagacgcgtcccttcgcagctggcgcacggacgattactgataaacttggctaattcttcgcgtaccgcgctggattccgtctctttatagcggcgctccatattatgcagcacgccttcgaacggatgacgacgaatggaggtatcgccacgatcgttcatgtatttgaattcaatgttttctttgccagaaccgtacaacaccactttatgcacgttcgcgctcaggctgccccacggcgcttcgacgtcgaacttatagtgatctgccagcgatttcagcatctggaaataatagaagttgcggcgatcccagccacggatcgcaccaccagccagcgacagttccggattctggatcactcgatcaggatcgaaatattgctgtacgccaaggccgtcgcaggtcgggcaggcccccgccgggttgttaaacgaaaacagtcgcggctccagttcacgcatactgtagccgcaaattgggcaggcgaagttggcggagaacagcagctcttccgctttcgggtcgtccatatccgccactaccgcggtaccaccggaaagctccagcgcggtttcaaatgactcggcaagacgttgggtaagatcgtcacgcaccttgaagcgatcaaccaccacttcaatggtatgtttcttttgcagttccagttttggcggatcggaaagatcgcagacttcgccatcaatacgagcacggatgtagccctggcttgccaggttctccagcgttttggtgtgttcgcctttgcgctctttaatgattggcgcgagtagcatcagacgcttgccttccggctgcgacagcacgttatccaccatctggctgacggtttgcgccgccagcgggacgtcgtggtccggacagcgcggctcgccaacgcgggcgaataacaaacgcaaatagtcgtggatttcggtgattgtccccaccgtagaacgcgggttatgagacgtcgatttctgctcaattgagatggcaggagaaagcccctcaatatgatcgacgtccggcttttccatcagtgacagaaactgccgcgcgtaggcggaaagggattcaacgtaacggcgctgcccttcggcatataaggtgtcgaaagcgagcgaggatttgccagaacccgaaagcccggtcacgacaatgagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtcagggtggtggcgctccggcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgatgacattccgttctgatttgtcattaaaacaataggttatattgttttaaggtggatgattaaagcatctgccagccataaaaaagaagcctccgttatggaggcttctacgtatcaggtcaaaatcattggccattgtggcggtgtctgattcatctcttctatcatcaccgactcgatgttgtgccagatagcggtgatgtccgccattgtgatgccaagcaaccccattgcgaaccaacaggcggaaacaacgcccagaccgctgctgatcaccgcaagcccgacataatcagaccgacgaaaacggatgttgagtgtgctggccagaaacatcattacggcactaagaagttgccagcgaagaagaaccacgccagtggtgagggtagccatcaaacaattcctctgaaaagagccgatgccctggacagcgcggcgttgttcacgggaggcgtggtacactctggctatcgcggggcttgcagaacacaaaaatgaaacactctgtttgtttcattaattttgtgaactatatcacaattgattgtttgttagccatattaggccgtgacttttattgctgtacagattatgtggtttttcagtggcattaagggcatatcttcccgccgcctctgcattcctgtaggaaattaattttgaatatcaatgaattattttcatccaggtgacgattagaaaggtatcaatttcaaatcaggcaaaagtgctatttataccgtaagatttatctaaagacgtcggtacccagggttttcaccttgcaatggccgggtataaacaggcaggaaattgatagcaatgagtcatcgtgcacgacaccaattactggcgttgccgggcattatctttttagttctctttcccatcattctttcgctatggattgccttcctttgggcaaaatcagaagtgaataatcagctccgaacctttgctcaactggcactggataaatccgagctggtcattcgccaggcagatttagtgagcgatgcagctgaacgctatcaggggcaagtttgcactccagcccatcaaaagcgaatgttgaatattattcgtggctatctttatattaatgaattgatctatgcccgtgataaccattttttatgctcatcgctgatagcgcctgtaaacggctatacgattgcaccggccgattataagcgtgaacctaacgtttctatctattattaccgcgatacgccttttttctctggctataaaatgacctatatgcagcggggaaattatgtggcggttatcaaccctctcttctggagtgaagtgatgtctgatgacccgacattgcaatggggtgtgtatgatacggtgacgaaaacctttttctcgttaagcaaagaggcctcggcagcaacgttttctccgctgattcatttgaaggatttaaccgtacaaagaaatggctatttatatgcgacagtttattcgacaaaacgcccaattgcagccattgttgcgacttcatatcaacgtcttataacccatttttataatcatcttatttttgcgttgcccgccggtattttggggagtcttgttctgctattactctggctacgtattcgacaaaactatttatctcccaaacgtaaattgcaacgcgccctcgaaaaacatcaactttgtctttattaccagccaataatcgatatcaaaacagaaaaatgtatcggcgctgaagcgttgttacgttggcctggtgagcaggggcaaataatgaatccggcagagtttattccgctggcagaaaaggaggggatgatagaacagataactgattatgttattgataatgtcttccgcgatctgggcgattacctggcaacacatgcagatcgctatgtttctattaacctgtcggcctccgattttcatacgtcacggttgatagcgcgaatcaatcagaaaacagagcaatacgcggtgcgtccgcagcaaattaaatttgaagtgactgagcatgcatttcttgatgttgacaaaatgacgccgattattctggctttccgccaggcaggttacgaagtggcaattgatgattttggtattggctactctaacttgcataaccttaaatcattgaatgtcgatattttgaaaatcgacaaatcgtttgttgaaacgctgaccacccacaaaaccagtcatttgattgcggaacacatcatcgagctggcgcacagcctggggttaaaaacgatcgctgaaggcgtcgaaactgaggagcaggttaactggctgcgcaaacgcggcgtgcgctattgccagggatggttctttgcgaaggcgatgccgccgcaggtgtttatgcaatggatggagcaattacccgcgcgggagttaacgcgcgggcaataaaattacaggcggtggcgataatcgctgggagtgcgatcaaactgccgacggaaaacgcgggagaaggtctgctgcgagacataacccaggtccattgcgatatcaaaaatcggacgctcggtggtgcgcaactcaacggcggccagtaacaggcggcgttggcgaatgtaatcgccaagcgtctgatgcgtcaccgtgcggaacattcgttgcaagtaccactttgaatagcctgatttttttgcgactacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagtaaagggttgattaccagtatccgtaacagcggcaatcagcggcgatataaacgtgatgtgttgcgatatgttgcaattatcaaaattgctcagcgtattggcattccgctggcgaccattggtgaagcgtttggcgtgttgcccgaagggcatacgttaagtgcgaaagagtggaaacagctttcgtcccaatggcgagaagagttggatcggcgcattcataccttagtggcgctgcgtgacgaactggacggatgtattggttgtggctgcctttcgcgcagtgattgcccgttgcgtaacccgggcgaccgcttaggagaagaaggtaccggcgcacgcttgctggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgtcaccgacgtttcttcgccagtgtaaaagtatactttttaaccgcaatatttttgtcatctcagacgattttttatcgcaatcctgaacggtatacggctcgataacgctgcaatcttgcgcaccgacgataacgtttgcgcatcaattgcctggtttttcatcgtcaagacaataaaagagaaaaaagcagcaaacttcggttgaaaaagccgctatgatcgccggataatcgtttgctttttttaccacccgttttgtatgcgcggagctaaacgtttgcttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggtcatcgtcgttccaggtatgttgggtaaagcaggcttcccgcctgcggcagttttcgttgcaacctgtctggttgccggactcggttctatcgtgatgggtctgtgggctaatctgccgttggcgattggttgcgccatctccctgacagcgtttaccgcattcagcctggtgctggggcaacatattagcgtacctgtcgcgctgggtgccgtgttcctgatgggtgtgctgtttacggtaatttctgccacgggtatccgtagctggattttgcgcaacttgcctcacggtgtggcgcacggcacggggattggtatcggtctgttcctgctgctcattgccgctaacggtgtcggtctggtgattaaaaacccgcttgatggtctgcccgttgcgctgggtgatttcgcgaccttcccggtgattatgtcactggtaggtctggcggtgatcatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggcgcgctgaatcctgtagtcctgccaagcgttctggcgctggtgatgacggcagtatttgatgccaccggaactatccgtgccgtcgccggccaggcgaacctgctggataaagatgggcagatcatcgacggtgggaaagcactgaccactgactccatgagcagcgttttctctggcctggtgggtgcggctccggcagcggtatacatcgagtctgcggcgggtacggcggcgggcggtaaaaccggtttgacggctatcaccgttggcgtgctgttcctcctgattctgttcctctctccgctctcttacctcgttccggggtatgcaacggctccggcgctgatgtacgttggcctgctgatgctgagcaacgtggcgaaaatcgactttgctgattttgttgatgcgatggcgggtctggttacggctgtattcatcgtgctgacctgtaacatcgtaacaggcatcatgatcggcttcgcgactctggtgattggtcgtctggtttccggcgaatggcgcaagttgaacatcggtacggtcgttatcgccgtggcgctggtgaccttctatgcgggtggctgggctatctaatctttcatcggattctgaaaacgggtggcaatggctgcccgtttttattttctccgcacattgtgtgagcttttgcgatattctgaaaaaaatgagaattcaggcataacgtctttctcagatcataaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatggtcgagagattttcggcctcgcgctggcgctggtggtggtcaccgtggtcggcattggcttccttatttactgggtggtgccgggcattccgctgatccctgcctttgcgctggcggcggtgctttctccgaccgatgctgtggcgctctccgggattgttggcgaagggcgcatcccgaaaaaaatcatgggcattttgcagggcgaagcgttgatgaatgacgcctccggtctggtgtcgttgaagtttgccgtagcagtggcgatggggacgatgatcttcaccgtcggcggtgcgacggtcgaatttatgaaagtagccattggcggtattctcgccggttttgtggtgagctggctgtacggtcgctcgctgcgattcctcagccgctggggcggtgatgaacccgcgacgcagatcgtcctgctgttcctgctgccattcgcttcttatctgattgccgaacatattggcgtttccggcatcctcgctgcggttgccgccgggatgaccatcacccgctccggtgtgatgcgccgtgcgccgctggcaatgcgcctgcgtgcaaacagcacctgggcgatgctggaatttgtctttaacggcatggtgttcctgctgttaggtctgcagctgccgggtattctggagacgtcgctgatggcagcagaaatcgaccctaacgtcgaaatctggatgctgtttaccaatattattctgatatatgcggcgctgatgctggtccgtttcggctggctgtggacgatgaaaaagttcagcaaccgcttcctgaagaagaagccgatggagtttggttcgtggaccacacgagaaatcctgatcgcgtctttcgccggggtgcgtggggcgatcactctggccggtgtgctctctatcccgctgctcttgccggatggtaacgtcttcccggcgcgctatgagctggtgttcctggcggctggcgtcattctcttctcgctgtttgtcggcgtggtgatgttgcctattctgctacaacacattgaagtcgcggatcattcgcaacaattgaaagaggaacgtattgcgcgagcggcaacggcagaagtggcgattgtggcgatccagaaaatggaggagcgtctggcggcggataccgaagagaatatcgataaccagctgcttacggaggtcagttctcgcgtcattggtaacctgcgtcgtcgcgccgatggacgtaacgacgttgaaagttccgtgcaggaagagaaccttgagcgtcgcttccgtctggcggcattgcgttctgaacgtgctgaactttaccacctgcgcgccacacgggagatcagcaacgaaacgctgcaaaaattactgcacgatctcgatttgcttgaagcgttgctaattgaggaaaatcagtaagccgaaagcgacgtaaccaggcccgaggtaatctgaaaaaggtgcaatcttttgcacctttaacaggttagctcgggctaacattcatgattctaaaacaaataaattatctctcttttaaagtcaattcattggctgttcttcgacttaacctcaatctgcatcttgcataatatctgcagtaatcttcatagcgactgcatgaagattatcctcagtttgtgacatgccagtatgagtggcacaatcttcttcaaagaatttctgtagtgttaccaggatatcactattaatggagatattttcctcaccacggagaatggtaatacccattccctggacgctagcctcatcgaaattaacacgatagagacggatattaaacatccaggcttttgttaaaacagaacagttgaaatggcaattgcttaaattggcattattaaaattaacattagccatattagagtcggtacatataaccatttcgaggaacgtatttgttaaccgcgtaaaaaagagtttgctatcaattaagtttatattctggagggttgctttattcaggttgacacgagacagatcagcatgttcaaagttaattaaatcaagtttagagaagctaaggtcggctctaaataaattaatatatggcgctattactttataaagatttacctcagccatgtatgccatataaaaatttgaataatcaaggaaggtatttttaatattggctctattcattgttgcattgtagaattgaacatgcatagcggaacatgaatttagagttccgtcagtcatttttatctgagcgaaatttgagtcatcgagaatacaattatcaaaaagtattttttccattatggcgaaattaaaattcgttttatacatattacagtcctgaaaaatagcgttttgtagtctgcaacctgcaaaattcgaattggataaatcttcatctttaatcacgatacctttcaggctaaggtgtgaaaaatcgtaaccaccatttactgtctgtgggatttcgatagtattattatggacggtgacattatttataaaatataccaccttaattgacacttccttatctttattaaggtaaactcttctcgtaattctatcgtcacatttattatttgcatgtgaagctatatctataaaatatttatgtattttcctgtccgtttctttcgtgatttttcctgatggtaaactatcataaattcttttcattttctgaatcaagcctatcactttttcatgatcatccattttgaaaagagagagggctttattgtcaattaacgtgtttttatgatgtttgctgtaattatctgattttgttttctttgtatgtgatggacttgtgacagagtggttatcgttaatcaggcaaagagggaaaaacatattatttaaaccattatagcgcataaaatatccttataattaacaagaaagaaaaggcatattctctgcattatcattttctacgactgtcaaaaatcgctcattttttaatgagtttatttgtttaatattatgggaaaaggtgatgcatttgggagaggaagagtattccccggtcagacgaccggggaaggggagagattaatgcgcgcggccttgctcaacgccaaagccggtctgggagcggataaactgcgcgcggaacagttcacgctcacgcgcgccttccgctgagttatcggttgccgagaagaaccagatgccgaggaatgccacggtgatagagaacagcgccgggtattcatacgggaagatggctttttcgtgaccaaggatctgtacccaaatcgtcgggccgaggatcatcagtactactgcggtaatcagccccagccagccacccatcatcgcgccacgcgtggtcagtttcgaccagtacatagaaagcagaatgatcgggaagttacagctcgccgcgatggcaaacgccagccccaccataaaggcgatgttctgattctcaaacagcacgccgaggataatcgcaatcacgccgaggatcagtacggtgatttttgatacccgcagctcttcacgttcggtcgcgccttttttgaagacgttagcgtacaagtcatgcgaaaccgcggatgcgcccgccagcgtcagacccgcaaccaccgcgaggatagtggcgaaagcaaccgctgaaataaaaccgaggaacaggttgccgcccactgcattcgccaggtgaacggccgccatgttgttaccaccaatcagatggcccgccgcgtctttatattccggattcgcaccaaccagcatgatcgcgccgaagccgataataaaggtcagaatatagaagtagcccataaacccggtggcgtagaacacgctcttacgtgcttcgcgggcatcgctgactgtaaagaagcgcatcagaatgtgcggcaagcccgccgtaccaaacatcagtcccagacccagagagagcgcggagatcggatctttcaccagcccgcccggcttcatgatgtcgacacctttcgggtgtaccgccatcgcttcactgaacagattgttgaagctaaagccgacgtgtttcatcaccataaaggccataaagctggcaccgaacagcaacagcacggctttgataatttgcacccaggtggtcgccagcatgccgccgaacaggacgtacatcatcatcagcacgccgaccagcaccaccgcaatgtgatagttaaggccaaacagcagctcgatcagtttacctgcgcccaccatctgggcgataaggtaaagcgccaccaccaccagagaaccacaggccgaaagaatacgaatcggcccttgtttcagacggtaagaggccacatcggcaaaggtgtagcgccccaggttacgcagacgttcggcaatcaggaacaaaatgatcggccagcccaccaggaagcccagcgagtaaattaagccgtcatagccggaggtaaacaccagcgcggagatccccaagaatgaggcggcggacatatagtccccggcaatcgccagcccgttctggaagccagtgatattgccgcctgcggtgtagtagtcgctacgagaacgtacgcgttttgatgcccagtaggtaatgccgagcgtaaacacgacgaaaatcaggaacataataatcgcctgccagttcgttggctggcgctctacggccccgctaatagcatccgcggcgttagctgcgaaagggagtgtggcggcaagcgccgtcagaactcttttcatgatgcttgtacctcatgcaggacttcattattaagacggtcgaattcgccgttcgcccgccagatgtagataccggtgagaacaaaggagatcacaatcactccaacaccaattggaataccgcgtgtgacgctggtgttcggattcagcggcgtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatagtgccattcatcacagattctccagaggtaatgtagggattgttttaattcccgctcccttatgggagaaggttaacgctcgggtaacccttgccgaatgtaggccggataaggcgtttacgccgcatccggcaatcaatgcctgatgcgacgctgtcgcgtcttatcaggcctacaaaccgttaccgactcgcatcgggcaattgtgggttacgatggcatcgcgatagcctgcttctcttcaagcagcttctcgactacgccaggatcggcaagcgtcgaggtatcgcccaggttgctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaatacctactacggcggcttcggcaatcttcggatgcgccaccagcgccgactcaatctctgccgtccccagacggtgaccggagacgttcagcacgtcgtccacacgcccggttatccagtaatagccatcttcatcgcgacgcgcgccgtcgccgctgaaatacatatttttgaaggtggagaagtaggtctgttcaaaacgttcgtgatcgccaaacagcgtacgcgcctgacccggccaggagtcggtgattaccaggctaccttcggtggccccctccagcgggttaccttcgttatcgaccagcgccggttgcacgccgaagaacggacgtgttgccgaaccggctttcagctcggtagcgccaggcagcggggtgatcatgaaaccgccggtttcggtctgccaccaggtatcgaccaccggacatttctcgttgccgatttttttccagtaccactcccacgcttccgggttaattggctcgcccacggaaccgagaatgcgcagcgacgaacggtcggtgccttcgatcgctttatcgccttccgccatcagcgcgcggatcgccgtgggtgcggtatagagaatattgacctgatgcttgtccaccacctgcgccatacgggcaggcgtcggccagttgggtacgccttcaaacatcagcgtggtcgcaccgcaggccagcgggccgtacagcaagtaactgtgtccggtcacccagcccacatcggcggtgcaccagtagatatcacccggatgataatcaaagacatatttaaaggtcagcgccgcgtacaccagataaccgccggtagtatgcagcacaccttttggcttaccggtagaaccggaggtgtagagaataaacagcggatcttcggcgttcatctcttccgcctggtgctgatcgctcgcttgctcaaccaggtcgtgccaccacaggtcgcgcccttcctgccagtcaattttcccgccagtacgcttcagtaccaccacatgctctacgctggtgacgttcgggtttttcagcgcgtcatcaacgtttttcttcagcggaatactgcgcccggcacgcacaccttcgtcggaagtgatcaccagtcgtgagttggaatcaataatgcgcccggcaacggcttccggcgagaagccgccgaaaatcaccgaatgcaccgcgccaatgcgggcgcaggccagcatcgcaaccgcggcttccggcaccatcggcatataaatcgccaccacatcaccttttttaatgcccagctcgagcagggtattggcgaagcggcagacgtcgcggtgcagctctttatagctgatatgtttgctctggctggcgtcgtcgccttcccagatgatggcggtacgatcgccgttttcttgcagatggcggtcaaggcagtttgccgccagattcagcgtgccgtcctcgtaccatttaatggacacattaccgggggcaaaggaggtgtttttcaccttctggtaaggtttgatccagtcaagaatttttccctgttcgccccagaaggtatcaggtacgttaatagattgttgatacatcgcctcgtactgctgagggtttatcaggcaacggtctgcgatgttggcaggaatggtgtgtttgtgaatttggctcatgcttttgttctccttgtaggatgttaataatatgtggcataagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcatgctgttgaaaaagaggaagatactgactaactctaaagtggtattttacatgcacttacaattgattaaagacaacattcacagtgtggttatttgttacacataggggcgagcaatgtcatgacagtgtaggtgcggttactgtcgtgaaaaacaataaaaaccgccattgcaacaatggcgcaattcggatgaagcccctatgacaaggataaaaataaacgcacgccgtatcttcagcttattgattccttttttctttttcacttctgttcacgctgaacaaacggctgctcccgcaaaacctgtaactgtggaagcgaagaatgaaacctttgccccgcagcatcccgatcaatatctctcctggaaagccacctcggaacagtcagagcgtgttgacgccctggcggaagatccacggctggtgatcctgtgggcggggtatcccttctcgcgcgattacaacaagccgcgtggacatgcttttgctgtgaccgatgtgcgtgaaaccctgcgtaccggtgcgccgaaaaacgctgaagatggtccgctaccgatggcatgctggagttgtaaaagcccggatgtggcgcgtctgatccagaaagacggcgaagatggctacttccacggtaaatgggcgcgcggcggtccggaaatcgtcaacaacttaggttgtgccgattgccataacaccgcctctccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggtaaaaacaacgtgacctgtatcgactgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcagcgctggatgcaggcgcgacggaagctgaaatgaagccaattcaggacgatatccgtcatgcccagtggcgctgggatctggcgatcgcttcccacggcattcatatgcacgcaccggaagaaggtttacggatgctcggtacggcgatggataaagcggcggatgcacgcaccaaactggcgcgcctgctggcgaccaaaggcatcacccatgaaatccagatcccggatatctcaaccaaagagaaagcccagcaggccattggcctgaacatggaacaaatcaaggccgagaagcaggacttcatcaaaacggtgatcccgcagtgggaagaacaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctgatgatcgctacgaagttacccagcagcgtaacccggatgccgcctgtctggactgtcataaaccagataccgaaggtatgcatggaaaacatgcttccgttatcaacccgaataacaaactgccggtcacctgcaccaactgtcacggccagccatcaccgcaacaccgcgaaggggtgaaagatgtgatgcgctttaacgagccgatgtacaaggttggagagcagaacagcgtctgtatgtcctgtcatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcagcgcaccaatccgaactttaacccggcgtctgttccgttgcttaaggagcagccatgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgcgatgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagaccaatttgcaggccggtaagttgcccgcgtgcgttgaagcttgcccgaccaaggcgctgacgtttggcaatctggacgatcccaacagtgagatttcgcaactgctgcgccagaagcccacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgctggtctggtgacgctggccgtgctgttacgtcgcttctacccgcaggcgggcggtgcagacagtacgttgctgcgcaccacgctgattgtcgggccgggcgcggtgatcctcggtctgttgatcctcgtcttccacctgacaagaccgtggaccttctggaagctgatgttccactacagttttacctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcagtttgtacaccgtatggaaatccctgtggtatggggtgaaatcttcctgctggtggcgttttttgtcggtctggcgctgggcgatgacggtaaagttcgtgcgctggtggcggcattaggtggcggtttctggacgtggtggttctggcttggtgtcgccgggctggggctgattgtgccaatgctgctcaaaccgtgggtcaatcgcagttccggcattcctgccgtgctggcggcgtgtggggccagtctggtcggcgtgttgatgctgcgctttttcattctctacgccggacagttgacggtggcgtaagccagaaaagaggtggtttctggacgtattccttcctgaagtcggttttctggcgttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcgcaacatagctatagcctgctgtcgtgggaactcaagctggcagcggtgtggggcggccatgaaggttcgctgctgctttgggtgctgctgctttccgcctggagcgcgctgtttgcctggcattatcggcagcaaaccgatccgctatttccgctgacgttagccgttttatctctcatgctcgccgcactgctactgtttgtggtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtctactgcgcggcgagtttgatggtgcctgcgcccgaatttgctggcgctgggcgttacctggctggagtgcattaacggcggggatcatcctcggttcctggtgggcctactgcgaactcggctggggcggctggtggttctgggatccggtggaaaacgcctctttattaccctggctttctgccactgcgctgctgcacagtttgtccctgacacgccagcgggggattttttgccactggtcgctgttgctggcgatagttactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcatttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggtctgttgatgctggtggtgattgtgctggcgacgtttgtctctggcaaacgcgtgcagcttccggcgctggtagctcatgcgggcgtgctgttatttgccgctggggtcgtggtctccagcgtcagccgtcaggagatcagcctgaatttacagccgggtcagcaggtgacgctggcaggatacaccttccgttttgagtgcctcgatctacaagccaaaggcaattacaccagcgaaaaagcgatagtggcactgtttgaccatcagcaacgcattggtgaactgacgccggagcggcgtttttatgaagcacgccgtcaacaaatgatggaaccgtcaattcgctggaacggcatccatgactggtatgcggtcatgggggagaaaactgggccggatcgttacgcttttcgtttgtatgtacaaagcggtgtgcgctggatctgggggggaggattgttgatgattgcgggcgcattgttaagcggatggcgggggaagaagcgcgatgaataaagggcttctcacgctactgctgttatttacctgttttgcgcacgctcaggtcgtagacacctggcaattcgccaatccgcaacaacagcaacaggcgttaaatattgccagccagttacgttgtccgcagtgccagaatcaaaacttactggaatccaacgcgccggtggctgtcagtatgcgccatcaggtttacagcatggtggcggaggggaagaacgaagtcgaaatcattggctggatgaccgaacgctacggagattttgttcgctataacccaccgttaacgggtcagacgctggtgttatgggcgctgccagtggtgttgttactgctgatggcactgatcctctggcgagtgagggcgaagcgatgaaacagcccaaaataccggtgaaaatgctgacaacactcacgatattgatggtatttctctgtgtcggcagttatctgttaagcccaaaatggcaggcggtacgtgcggagtatcagcgtcagcgcgatccgctacatcagtttgccagccagcaaaccccggaagcgcagcttcaggcattgcaggataaaatccgcgctaatccacaaaacagcgaacagtgggcgttactgggcgagtactatctgtggcaaaacgattacagcaattcgttgctggcgtaccgtcaggcgttgcaactacgtggtgagaacgctgaactgtatgcggcgctggcgacggtgctttattaccaggccagccagcatatgaccgcccagactcgcgcaatgatcgacaaagccctcgcgctggacagtaatgaaatcaccgccctgatgctgctggcttccgatgcgtttatgcaggcgaactacgcgcaagccatcgaactatggcaaaaagtgatggatctcaactcaccgcgagttaaccgaacacagctggttgagtcgattaatatggcgaaattgttgcagcggagattggattaatcatctggtgatgaagattatgtcattgagctgcataaaaaataatcgaatgaacatatgccaaaaataatcactaatcagtattattgcagattaaacaaataaaaatctttccataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagtcattcatatgaaaaatataaaattcagcctggcctggcagattctgtttgctatggtgctgggcattctcctgggaagctacctgcactaccatagcgacagccgcgactggctggtcgtcaatttgctctctccggcgggtgatatcttcatccatctgattaaaatgattgttgtgccgattgtgatctccacgctggtggtgggtatcgcgggtgttggtgatgccaaacagctcgggcgtattggcgcgaaaaccattatctacttcgaggtgatcaccaccgtcgccatcattttggggatcactctggcgaacgtcttccagcccggtgccggggtggatatgtcgcagttggcgaccgtcgatatctcgaaatatcagagcactacggaagcggtacaaagcagttcccacggcattatgggcacgattttgtcgctggtgccgacgaacattgtggcgtcgatggcgaaaggcgaaatgctgccgatcatctttttctcggtgctgtttggtctggggctttcttccctgcccgcgacgcatcgtgaaccgctggtgaccgtgttccgctccatctctgaaaccatgtttaaagtgactcacatggtgatgcgttatgcaccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggtgtcgatcaccagtttcgtggtgccgaccggttactcttttaaccttgatggttcgacgctgtatcaaagtattgccgctatcttcatcgcgcagttgtatggcattgacctgtccatctggcaggaaatcattctggtgctgacgctgatggtgacctcgaaagggattgctggcgtgcctggcgtgtcgtttgtggtgttgctggcaacgctgggtagcgtaggtattccgctggaaggtctggcgtttattgctggtgttgaccgtatcctcgacatggcgcgtactgcgctgaacgtggtgggtaatgcgctggcggtgctggtgattgccaagtgggaacacaaatttgaccgtaagaaagcgctggcttatgagcgtgaagtgctgggcaaatttgataaaactgcggatcaataattgaagattgccggggatatccacccggcaatgtgtgaatgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttacgccgcatccgacatcaacgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttaccgcatccgacatcaatgcctgatgcgacgcttgccgcgtcttatcaggcctatcttaaccgttggttaatttttcaaactcttcacacccggtatcaaacccttccatacagctcaggttcaaccagtgcagcgccttttgcttgttcttctcgataaaaccttcttcaccgtttaagaacatcattcccgcccagtactcggaataaccggttcgggaaattgcagagctgcgtttgaaataccaggttgccttgtcatcgtcggccttaatgcccacgccgttggcgtaaatcaaaccaagcagcatttgggcatcgacggcagagtcgttctccagatcttccgaggcgttttctaacagcgaaattgcctttggataatccggtttacccgcttgagtatttaccagaatatgcgccagcgttacttcaccttctttactgcccgcttgcgccgctttctctgcaagaacttttgcttgtggatagtccagactgaccggattggtgattttgatctgcgccagcagcgcgcaggcatcagcatcaccgctgtcggcggctttctgtgcccaatattcggctttgctcaaatcgccggagctaaaccagctgtcggcaagaaaatattgtgcgcgtcggtccccggcctctgctgcctttaaatactggctgccaggctcggagtcgttggcgtgggcaaagaatgtcaaaaacaacatcaatgcgataatttttttcattttgataatacgattgggtagggagtaaccagtataaagagttcgaatggataaaaaaacagcctccgaaaggaggctgtagaaaggacggtattacgccagtgccgcttcgcgcaggcgagttttcaacttgttgtactcgtcaatcacgtactgctcggcggcgcgctgatcggcgatcggctcgacgcgaacggcgcagtatttgtactccggcgttttcgtaatcgggcttaagttttcggtaaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtactcgtcggtgagtttgtcgattggcgctacccagtcgcaggtgaagaactgcgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcatcccagatctcctgggtgttgttgtagtgcatcggataacccatacgggtggcgatttcactgatgatttgccagtccgttttcagatcccatttcggttcaaccgccttgaagaaacgctggaagccacggtcagccgcagtaaacacgccttcatgctcgccccacgacgttgacggtaaaataacatccgccgccgacgcggttttggtcataaagatgtcctgaacgataaccagttccagatcttcaaaggctttacgtactgccgacagctccgcgtcagtttgtagcggatcttcgcccataatgtacgcggcacgcacttcgccatgcgctgcgcggtgcggcagctcgctgatgcgatagccggtatgcgctggcaggctttccacgccccaggctttggcgaatttctcgcggttagccggatctttcacgtactggtatcccggatacgtatccggcagcgcgcccatatcgcaggcaccctgaacgttgttctgaccacgaaccgggttaacacccgcatgcggcttaccgaggttaccggtcagcatcgcgaggctggtcagagaacgcacggtttccacgccctggtagaactgggttacacccatgccccacaggatggcggcgcttttcgcctgggcatacatccgtgccgcctgacgaatctcactggcgctgacgccggtgatatcttcaaccgactccggcgtgtagccttcaacgattttacgatactcttcaaagccttctgtacgtgaagcgacgaacgctttgtcgtacagattttcttcaataatgacatggcccatcgcattcaacagcgcgatgttcgagccgtttttcagtgcaatgtgcatgtcagcaatgcgcgcggtttcaattttgcgcggatcgcagacgataattttcgccccgttacgtttagcgttaattacgtgattcgccacgattgggtgggaatccgccgggttgtacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccacgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaagtcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatgtggggtcattccctgatattacgggcactatttattcaaaactctgacgaaaaacaggctgtcgtcagttttgacgtgacgaaacgaaataccgcgtgacagccatcacgcggcagacattttattttttctcgacgacgggacctgcctgatacccgccgcccagcgatttcatcaactgaatgctttggatcacccggcggctgtccagcatcagtaatgacatctcttcggcaagcactggcaaccgggcttcggtggcctgtaagcggctggttaagccgcgctgataggcggcctcggcagcgcgctgggtaaagcgcgtggcttccacgcgttcagcctgcatttctcgctcgtcgttgagcgtttgcagacgcgtgccgttgacggcaacgtcacgcaccgcgttcagtactgactggttgtaacgttcaatcatcatgttgctggcggcgcgcgtgccttcgagattggcattcaaccgtccaccgtcaaacagcggcaatttcagacccgggatgaagttgaactggcgactggtttttttgaataaggtatgcagatggatggagtccagaccgaaaaacgctttgatatcaaagctcggatagaacaacgcccgcgcggaatccacctgatctaatgacgcctgaacataccagcgcatggcttgcagatccgggcgtctggcgagcaactcataagagagtgtcgccggaatgccggtctggacttgcggtaatgccaccggtctgatctccggcatatcgctggctcccgcgccaatcaatgcacgcagagattctcgcgtttcggtgatttgccctttgacggcaacaatttgtttatcgaccgccagaatctgtgcccgcgcgccgtggaaaggcacttgcgcttccagaccgtgcgccactttactctggtgcgctttcaccgcgtaatcaatcacatcgtgagtttgttctaacagatcgagcatctgatagctggcctgcatactgtaataaagctgcgctacgcccgtggccagcgatagctctactgctgcggtttctgccagcgcggcattatgcgcgccaatggcggcggcaaccgctgagcgatgcacaccccacaaatcaagatccagtccggcaaacaaacctactgtggcttccgtatagtacggcccgtccatacccagtgctggcgcatccattgaataagggcttaaaaagccgttcgccgagacacgttggcggttgagcatccctaacgctgcgacctgtaattgtgaaccggcatctaacaaatcggcctgggactgcgctttttcttcccgcagtttcgcttcggcgagggtgtgtgaaccacttagcgtccgttggatcagcgcatccagctgcgggtcattgagttgtttccaccactgcgcctgcggccagccggagctggcaagatgaatatcgtcggccagtttgatttgttccggtttgagctgttgatgaggtgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggggctgtccagtctggcaagcgggcgaaaagctggcagacgtgttgctcctgttttaataaggtgggcaggatggcctgagaggcgggtgtctcttcaagcgttatttgaggagaacggctgagtgcggttgccagaccggcagcgtatttctccagggcgtcggcaaactgacctgctctgtccggctgtagtgcgttatccagcgcctgcgccgagttccaggtggcatcccaggcgtgaagaagatcgcggccctgacgaataaccgtttgcgaacgttcaatcagtaatgcgcgttcttcgctgtccagttgacgctccagcgccacgcgttggcacatctcttcacaggcattaaacgccgcatgcagaccgatacgaatttgcagataagtgcgcagagccgtgacttcctgctggcgtgggatccgcattactttacttaacatacccagcgtgccagccagtttttgcggcagtgtgcgcgcttcactttcaggccagacaaaggtgtaaatcaccgcggacaccacggtaccaatgatgatacccagggcgcgatcgcgaatttccaccaggtcgtacactgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagcgccagaatcgcgccgcaaaaggccccgccaaaacgcagcaccatcttctggtacgacgaaccgacatttgggttagcgacgatcacgcatgtcagcatacaggtgtgaatgccttcccagtccacgccgctgtaaaaggtgtaacagatcaaacaggcgagcagcgtttttaccgcgtagcgcatatagtctggattggtaaaagcatcggcggccattgatggcggtttggctgcgggcgttggcggcgtattcgggtccatctgacccagttgtaacaacgtctggcagatattctccaggttacattcccgtgccgccatcgcttcactttcactgatccgccagtcgctttgccagcactgaccttcagcaacggcatgctgcagcttgttgatttctgaagctaatttttgtcggaattcaataattgcctgagaatcagcaaaagaggtgggatcgtagcgattcagcgtcgagtaaatgtaggttaccgttgccacgcagctttgccaccatgcgttttgagttcgccagttggcatcgtccgcgaggcaaaagacattgagtttttgtagcgccagcgcctctctttcaatccgcgtttcgggtagcggtgcgaggctgtctgtcaggtgactaatggcatcatcaagccgatcattaagcgcctgatgcatttgcgaaatggcacgactgggaaaccacagcacgccgattaacgtcatcagcaaggttggatagaggccaacaacgatacaccacagcgttaagcgcacgaccacttccggatagtcgagcatggcggggaaggtttgcccgtaaatagcgacaatggcgacggcgaaaaagaccagccccaagcgatgggtgcgcatcaaaaacatgcagcccatcaggatcggtccggcgatgatcaatcggatcaacggttcgccgtatgaccatttgtagatcaaaaacaggctgccgatctccagcaccgtggcaaccacaaacaagatcgcgacaaatttggtgtaaaacgcgttcgactgaataccgtaaaacagcactgccagcgataacgccacaaaagggatctcaaaggtcatcgagatcagaatcaccagcaggcagcctacccagagttgcacggtctgcggcacgcgacctggtcgccgctcgcttaactcttcatgaaagaacgccagcagcctgaccaccggtaatggcagggagttgagcgcgctcattattgcggctcaagattagcgactgccgaagcgccgatgcggaacatttccgggtcaggtttatcgaccatgattttgaccggaaaacgctgggcaacgcggacccagttaatagaacgagacactttcggcaggccgcccagcaccaggccgccgtcatccggtagcacgccgtagccaatcgaatccactttaccctcgaaggttttgccgctgtcactcatcaggcgaatcgttgcgggtgtacctgagcgaatatttttcagatcggtttcgcggaagttggcgatcacataccagtgacgagtgtcgattagggtaaaaatagggcgcatggcagaagcaaattgcccgacggaggttttgagggaaatgacccggccatcaaacggcgcgcgaacggtcgccatttccagatgcagtttggtcagggcaatatccgcttcgaccgccgcacgctgggcaactaatgcatccacgccgctgacggcgctggcggctgactgcgcctgtaacaatacggcattaagatccgcttctgcggcgcgctgcgccgttcttgcacggtcaacatcttccgctgagacaaaaccttctttcagtaatggctcggtgcggcgtaatgtatctgtggcctgtttcgcggcggcacgggctttttctaccgtggcattaaccgagtcggcaccaaactgttgcgcgtcaacgctacgctgggtgagcataatttgcttatccagcgccgcgagggaggcttcagctttcgccagattggcttcgtacgggcgcgggtcgatgcggaacagcaaatcgccctgtttgactgcctggttgtcggtgaccgccagttctacaatgcggccgctgacttccggtaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgcccgctgaataactcgcctcgtgatgagcgtcaaaataaggctggcaatggcgcagaaaaaccagctgggataataagcgccgatcaccgggattgccggagataatgagcatcccgaaaccatgaagacgggaattatccaggctgtttttttgagttgcatcgccatgcgagagagaactgttggcatattaaatacatcctgtctgctgcgaacaatatctgtagtgaatatcaatatccattgaaggcgtcagtatggctattttcttgatgaataaaaatagctttattcagccaccgcattcataacttatatattttatttattaattggctgtatatatttttaaaataaatacttttgggggcttcagcgcccccaaaagcgagtgacattaatttggggttacgatattcacccacaaatcgaaattatccagacaggcgataatttcttccagtttcgcgccattgccaataattttggctttcttcgcttttaccagatccgccattttggcttgtccggtcagcacggcgtgcagatcttcacggctgatgtagaaagaggcgtcggcttgcggttgcagcgttttccggtagttaagcacgctatcgttcagcgtcaggttgaggttatcgccgttgctcatattgaagttcaggctgatatttttacccgcagctttcgcgctatcgaggcgaacggccataaagtcgaacagcatttcgaccgacatcccgcgaatggtgtccggggaaccggtggtgccgtggctgaacttatgcaccccttcgcgcagctctttcgcgccggtcaggtagaaaccgcgccatgtggcggactcggcctgatagcccagctgttcaaagttattcgcttgcagattcttcgcgacctggtcacccgggttggcggcaatcacctgtttcagcagttctgccgaccagcggtaatcaccttgcttgttcgcttcttgcgccaggttgatgacacgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccgcggctggcccagttattggcaagtgcaggcggcagcttaatcatgtcgccgatttcattcatggtgtagccctggttcgccaggtgcagggtctggtcgtgaatgtacttgatggtatcgcggtatttaccaatataatcattgatatgcttattgccccagaccggccaggtgtgcggcataaacagcacttccgcgtcgttaccccacatatccagcgtttcgttcagatactcggtccacttgctggtgtcgcgggttttcgcgccgcgcagagtgtagaagttgtgcagggtatgcgtggcgttctcggcggtacacagggctttcagggccggaatatagaagtgcatttcggctggcgcttcgctacctggggtcatcaggaagtcaaactccaggccgtcgataatcatcttctcgccagttctgacgatagttttcgtcggtgcaataatgctcgggtcgcccgttgccagcgtcacgccaaggccattacccacattgccttgcgcgttgtgcggcagtaacagaccgtaagagtagagcgcacggcggctcatgatgttacccgccagcacgttttcgctgatggcttcgtccataaagcctgcaggggcaatcacctgaactttgccggatttaacatcggcttcagagataatgcctttcacgccaccatagtggtcggtgtggctgtgagtgtagataacggcaacaatcggtttttgcggacgatgctggaagtaaaggtcaagtgcggcttttgcggcaggcggcgtcaccagcgggtcgataacaataatgcctttctcgccctcaacgaacgtaatgttagagatatcctggccgcgcacctgatacattttatcggtgactttgaacaggccagaaataccgttgatttgcgactgacgccacaggctggggtttacggtttccggcgctgcggcattaatatcaaatttgtaatcgtccgcgcggtagtaaactttaccgttcgcatcacgcagaataccttcatccagcagcggggcgataaatccacgctgggcatcgtcaaaatcctgacgatcgctaaacggtaatgatttggcgtaattctgattaacctgttgggtatattgagtggcggctttcgcttcctctttcgcgttagcggtatttaccatcatgccgctggcggcagttaacgcaataacaatcctgctcaaacggaataaccgagagttattcatataaatctccatttatcatttatgtcgtaaatatgtaatccatgcaaaatacgtcatttaaagctggcgttatcataattgggaaattgcgactttaataagtggaagtgtgagcggaacgcgccattttattaggcatttgtgctgaagagggaaaattacagtaaaactatcattgcagaaaataatatgagtcgttttatgtgtttattatatatattgtacctgtcgttggcacagcgggacattgcgctactgtgccaacgttttactcatggggctttagcacagaactgtggcaaaaaacgttgatgcgccaatattgctgcaccctgagcgccattaaagtcagaagatgaggcggcaataaagcgcacgacctgatgcggcagtggacggcgcaggtacttttgggtcatggcaacgagagtctcgcgtgggaaggcgggcatatccatcacgccaccgcccaggatcaccgcatcgggatcgaacagattaatgctggtggcaatggcccgtgccgcgttttcaagcagactctggacgaaaggggcgttttccgcatggacgaaaagatcgcgcaatgggtaatttcggggctgttgttcgtaccagcgtcttagcgccattccagagcaattggtttccaggcacccaggattgccacacgcgcagtgttgggtcatatctcccagggggatatgacccagttcgcctgccacaccgtgtgcacccgtccacggcgcaccgttcatccacactgcgaaccccatccccgtaccgagataggccgccagaaccagttgttgcgtaaggcggttttctactacgtcccaggagagttgcaggttaacgtcgcgggaaaactcaaccggacaattcagcgtattttcgagcttatcggcgagatcatataaatccgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggccgggagcaatgacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcggtcataattctccatgcttcgtcgatattttccgcatgattaaacaggccggaagtgccgacgataaagacatccgcccctgccgccatcagtttttcgtaagttgcctggttgcaggaaccgtccacctcaatttcgtactccagaccttctcgttcacgccatgccttcagttcggcaagtttatccagcatttcaggaatgaacggttgtccggcaaagccgggatcgacagtcatgaccgtaattttatcggccttatggatatagtatttcatggcctcaactggcgtctccgggttaaggatcagccccactttcatgtcatgacggcggatttcatcaatcaggcggaacgcctggccgttgatggtttccggatgcagagtgatgaaatctgctcccgcacgcgccagttgagcaatgtaatcctgcggccgcgtcaccatcagatgacagtcgagcggtttagttgccagttttttaacctgacttacgaagaacggtgagagtgtcagattggggacaaagtgaccgtccatgatatcgatgtggaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgaatttttgttgccgcccagtgcgtagatgttgcgcccgagccgcatacgcgttgtcagaaaccaaaggatgagcgcgacaattagtgagaagataacggggacaggtatcccaattacgctggcggcaaagaagttcacgaagtcaaatgagaagccgtataccgagttggcatcggagatcaccagcgtgatcccacggaaaatcgcgttggtgccaagggtgatgatgaacgggtgtagccccgtccagttgaccaggcagccgttgatcgcccccagtgcgccgccaaccagtacaccgccaatcatcgctgcgagaaacgggtcaacacctgccaacatcagtttggcggtcaccataccggaaagcgccagaatcgcgccaaccgagaggtcgataccagcgaccaggatagcgaaaaactcgcccatgccgatcaataccgtcacggagctttgaacaaaaatctgggtaatattattggtggtcagaaaatattctggtgacagcgaaccaaagatggcgacgatgatcgccaggataaaaaaggtgccgtatttatcccagaacagcgcaaagttgaacggtttcttctcgctcgcttcgctttttactcttgtggtaaagcccatgccataatctcctcttcgctcatgtcatcgcgattcgtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacgtcgatgccgcgggtaggttcatcgaaaataatcacttccgggcaacagcacagccatttggagatcaggactttctgctgatttcccccggagagttcggtgatattctggtttaccgaatgacatttcagcgccagcagttcgcgttgattttcagcggtacgttgctcgtcaacttcatgaaacaagcccatcgcgcctttatagccgccgtctttcagactgcggctgatcgccatgttctgagcgatggaaaagttggggaaaaaaccgttatcccggcggctttcagtgatgtaagccatcccttttttcacggcatccaggggtgaacgtggagagatatctttgccattaagacggatttctccgccagcgcgtttatccacgccaaacagacaattcatcagttcagtacgtccggaaccgaccagtccggcaaagcctaatatttctccccggcagacgctaaatgagatatcccggaccttttttctgtcacgactggtgacgttccgcacctcaaaaaccgtttcgtgcgcaaggttgctgacattctccttcatcgcgttaaaacggttttgcagttcgcggcctaccatcagacggacgatatcgtcatttgacacatcgcttactatgccgctgcaaacgctgctgccgtctttcatcaccgtatagcggtcgcaaatacggcgaatttccgccaacttatgcgagatatagacgatggccgtaccctctttacgcaactgattcatgatcagaaacagatagtccacctctttattggtgagtgaggaggtgggttcatccatgatgatgactttggcatcgagcatcagcgttttggcaatttctagcatctgcttgtggctgatagataaattcgccactttctcatctagatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagcttgttatagctaatgttattaatggtaatggtgcctttggtcggctcatgtattccggataaaactttcattagcgtggatttacccgcgccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatggctacatttatcaggtctacgttcaggttattttgttggccggataagacacttcattagcatcatcatccggcatcattcagttttattgagtgaccaggattgaatcgaccagtttaaattccggtgctttatccagcgggataaccttgccggatttctcagcgtcaaccatcagcttcagacccgttgcgccgatatccgccgggttctgggcaaccgtcgcggtcatttgtccggcttccaccattttgcgggcttccggaatgccatctgtaccgacgaccagcacttttcccgtttttccggcgtttgcgactgcctgagcaacacccattgccatcgtgtcattcgcgcaatagatcgctttaatattcggattacgttgcaacacgttagtggcgacatccagtgctttaatgcggtcccagtcggcaggctggctggcgacaagcttgatctggcttgcttttttgaaggcttcggtggcaccattacgacgcgcttcaccggaggcgttaccggctttaccctcaatgattgcgacttcaccaccttcagcgcccaatttgtcaataatgaacgacgcgcctttcgccccgacagcaacgttatcggtggtgacaaaagcttccacattgccgccagcttttttcagattatccatgtcgattttttcatcgagattaaccagataaatgccttttttccatgcgcgggcgacaggcatgaccagattcactgaggataatggagcgaaggcgatacctttgtaatttttattactgagatcttcaaataactgcaattgagattgaaaatcgccttctgaaggagaggcaaaaatatcaacgctgacgcccagtgtttttgcttcatcttcaatgccttttttcatatctacccaaaatgggttggagagggttttcaatacgacagcatattcggcggcagcaaaagcgctggttgacaacattaagcccacgagtgtgccgctgaaatatttcagatatttattcataataatgttctcacggtaaggggacaggtaactccgcgatggcggaattacctttttcttatttcagcgcgcctggtgagaagaaatcaacaattgcgccggttttttgcatattaatattagcttgttcaatgttgagctgggcgacagagacaaaaaaagcgtccagcaaagttagttgtaatattcttgccgaggcattacgacctaataacggcgtttccggggctggtgagcaaataatataatcggccagtttcgctatcggtgaatggtagctatgggttatacaaataatctttgccccgttcttttttgccagttctacggccgcttttacatcactggttcgcccggaatgggtcactaccagcacaacatctccttcctgtaacaacgaagcggacatcatcatgatgtgagcatcaggataggcctgacagcgtacgccaatgcgcaagaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacctgttctgactgagaaaaataatcttccagcgcactgcgtaagttacgaaagccgctaaaccccagcagctttgataccttaactatcatcgcttcagataccgccagagcttctgcgacatctttaattgcgggtgcacaactcaggttaccgggtttgagtaaccactccacgatgcggctttcattttctgtcattccttcctgcttcattcgcaggtaaggcgctaaccctataccgttcggaagcgctgaatcaaactctgactggctcatcacgttctcttgtccttgaattgaagacgccactatatcaccacagcaagaacagaaaagatgctggcgacttcacaaaaaaataaaatttataaagtttattttattgtgaacaatggcgagtggcttaaaattttatttcatttaattagtttaaaaacatgatgttatttgtttttctggttttttagatgatagatgttgctggatggtgagtgtctttaacgctattgcgctgtcagatgtaactctgtaaaacagatcaggaaggcgtaattcatcgattttgggtgtttttaattcattaacatcacaaatgttttttgattgtgaagttttgcacggacggggaagatgaatgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattgagattcatccactacttgcatggatgagtaatgattaatgtggatagagtttctttttgaggttggctaatgaaacgctttccgctatttcttttattcaccctgctcacgctgtccaccgttccggcccaggccgatattatcgacgacaccattggcaatattcagcaggcgattaatgacgcttataaccctgaccgtgggcgagactatgaagattcgcgcgacgacggctggcagcgtgaagtgagcgacgatcggcgcagacaatatgacgaccgccgccgccagtttgaagatcgccgcaggcagctggacgatcgccagcgccagcttgatcaggagcgtcggcaactggaggatgaagagcggagaatggaagatgagtatgggcgatgaggttgggtatggagcaggcatcgcccctcaccccaatggggagagggagaaaacgagcgcaatattcaatatcgagcacaatcggtcccctcgcccctctggggagagggttagggtgagggggccagcgcgcacattccctctcatcacgccaccccaatctccatcccatcaaaccccacctcaaaccctgacggtagtgcgttttccatcagccacgcatcaaactggtggctgatatgggtcagaatcacccgtggcgagcggataacctgattcagcgcaagcacggtatttaaatcacagtgattacgcggtgcatccgcgcgcggcgggtgactgcaatccatcaccattacctgcggctgattattgcgtaaaaatttcagcgttttttccggcaagcctgcggtgtcagacagccacgccacccggctgtgtgccgtttccagcagataaccgaaggtcagttttgagtggttgagcggcaggggcgtgacctgtaacccctgcaaatcaaacaccacaaacggttccaccgtgtggctgaaatcaagcaggcccggatgtttaaacagatcgtcgcagccctgttcatccggcgggccgtaaaccgggatcggatcgccaacgccccagcgcagcggaaacagcccctggacgtgatccatatgataatgcgtcagcaaaaactgctggaacgatccgggcgaccagcgatcggcgagatcgtgcagcccggcgtcgatcagggtgattgcgtcgttaaacttcactacgccgctgcacggttggcggcgatactgcggcgagcgccgcgctctggcgcaggccgcacactcgcagccccatgccggaacgccctgtgcgccgccggtgccggtgagcgtgagggtcaggctcatgttacagcgccttggtgaagcggaagtggctctgctcgtagccttcgcgcagatagaaacggtgcgcgtcgtggcgcttcacgttggtcgaaagttcggtcatttcggccccggcctggcgggcttcttcttctgcccacgccagtaacttactgccgacgttcagaccgcgcgcctgcggcattaccaccaactcctgaatttcgccgatccagttgacatgatgcagatgaaactgcaaatgcaggccgatcatgccgacaacttcgccatcaagcagcgccagatggtagcgcatgtttgggtcgcgcagattggcgttaaaacccacgcgaaacgcgtggtggtcaaactccgcctgttttagctcacaaatcagcgcgtaaaccgcgtcggtgtcgtactgcgtggccgggcgaagctcacaagcaggcatggtgtttctccttctgatggatcagcgtcagcagcgtgtcgaccgactggcgcaggctgccgtcattgttgagcgtatggcaatcctgtggagtatagcgggcggcgcgcgccaggcgggcgttaatttcactggcgttttcacggccacggttttccaggcgctggcggaggatctccggcgaaacctgtaaacagacgggcagcagcgccgattgatagcgcgcccgcgcctgcggcagatgggcgcgtgagccgttgaccagcacgtcgaatccggcgtgcagccagagatcaatctcgacgccgacgccataatacagaccgttagcgtgccagcttaaggccaacagattttgccccgcgcgggtaaaaaactcctgctcgctcagggcgatatggttttcacttccggcgctggcatcgcgcgtgatgtagcgatgcgccaccagtaactgagtttgttcccgcaggcggagttccgccagcaggctgtctttcccggagccggacggccccattaaccaaatcagttttcccatcatcagaacacccttttaccctgacgccagacgtggtcgatatgaatatgattgtccttgcgatgcgccagcaccaggtcggcgcgtttgccctcgccaatcaccccgcgatcctggagattaagcgcctgcgctggatttttagtcaccagcttcaccgcctgcggcagcgtaaagcggttgctctggtcatcggcgacgcgaaatgccgcatcgagcaggctggcggggtagtagtcggaagagaggatatccagcaggccaagctgcgccagttcactggccgccacgttgccggagtgcgagccgccgcgcacaatattcggcgcgcccatcagcacgttcatgccatgcttgcgcgaggcttccgccgcttcgaacgtggtgggaaattcggcgatcacgctgccaagctggtgagattcagcaacgtgggcgtgggtggcgtcatcgtggctggcaagcgcaatttttcgcgcgcggcacagggcggcgatggattcgcgattcggctgcgaccagcgtgcggcgagcgccagttgctcttcttcgtactgctgcatctgcgcatcagtgagggagtatttgccctgataatattcgcgatacttctcgcggttggcgaactggcgctggcccggcgagtggtccatcagcgacaccagcgtcaccggctcgcgctgcaccagtttttcaaacagcggcagcgtggtgtgatgcggcagttcgcagcgcagatgcagacggtgctcggcgcggttgacgccgcgtttctgcgtctcttcgatggcgttgatcatcttctccagattctccagccgatcgccgccgtcgcgcacgtcgccaattgccacggcatccagtacggtggtgatgccgctcgccaccatcagcgcgtcgtggctgctcatcgccgagtgggcaggccagtcaactttcgggcgcggggtgaagaatttatccagattatcggtatgcagctcaatcagccccggcagcagccagccgccttcgccgtccatcgcctccggcaggcggctctggctttcggcaaaggcgcggatttcgccgttctgcacctccagcgaaccgcttaccacctcgttttccagcaccagcttaacgttattgataatcatgaagaggctcccattgggtgcaggcggtcggcgacgtcattacgtacagcttcgtcatggaagatgcctacgatggctgcgccacgggttttggcttcgcgaatcagttccaccaccgcggcgctgtttttggcgtccagcgaggcggtaggttcgtcaagcagcagaatggggtagtcgacgataaagccgcgggcgatgttgacgcgctgctgttcgccaccggaaaatgtcgatggtgccaggtgccacaggcgttccggcacgttcaggcgggtgagaagacgcgcggctttagcggcgcaggcttcacgcggaacgccggtatcgagcagcggctgcatcaccacttccagtgctgagatacgcgggatgacgcgcagaaactggctcacccagccgacggtggttttgcggatttccaccactttgcgcgctggcgcggtgaccaggtctacccactcgtcaccgtgtttgatctggatttgaccttcgtcgggcagatagttggcgtacagcgagcgtagcagagttgatttgccgctgccggaatggccgtggagcaccacgcattcgcccgcgttgacggtgagcgaggcgcgattgaggacgggcaggcgcacgccgttttgctggtgcaggatgaaggttttactgacgttttgtacgttaatcatttttcgcctcgtggttcgggtgtcggatgcgacgctgacgcgtcttatccgacctacggggagcgcatttgtaggccggataaggcgtttacgccgcatccggcaccggctcaattctgcaaaaccgatgacaccagcagctgtgtatacggatgatgcgggtcgtcgagcacgcggtcggttaacccactctccaccacttgcccctgcttcatcaccagcaaacggtccgccagcaggcgggcgacgcctaaatcatgggtgacaatcaccaccgcgaggttcagctccaccaccaggccgcgcagcaggtcgagcaggcgggcctgcaccgacacatccagcccgccggtcggttcatccataaacaccagcttcggatgcgtcaccaggttgcgggcaatctgcaaacgctgctgcataccgccggaaaaggtggtcggcaggtcgtcgatccggttggcgggaatctccacctcttccagccacttctgcgcggtggcacgaatatcgccgtaatgacgtgccccggtcgccatcagccgctcgccgatattgccgcctgccgacacctggcggcgcaggccgtcgagtggatgctgatgcaccacgccccattcggtacgcagcaggcgacggcggtcggcctcgctcattgcatacagcgaacggttctcgtagtgaatttccccctgctgcggcgtcaggcgcgcggagatcgacttcagcagcgtggtcttcccggagccggattccccgacaatgcccagcacttcccccggccataaatcaaaagagacatcgctaaagcctttgcccggcgcgtaaaggtgggtcaggttattgaccgaaagtaacggttgattcattggttttttgcctcgctctgttggcggcaataatcggtatcggagcagacaaacatgcggtttccggcgtcatccagcaccacttcatcaagatagctgtgggtcgatccgcagatggcgcatggctcatcccactgctgaacggtgaacgggtgatcgtcgaaatcgagactttccacgcgggtaaacggcggcaccgcatagatgcgcttctcgcgccccgcgccgaacagttgcagggcgggcatcatgtccatttttgggttatcgaatttcgggatcggcgacgggtccatcacgtagcgcccatttaccttcaccggataggcgtaggtggtggcgatatgaccgaagcgggcgatatcttcatacagtttcacctgcatcacgccgtactcttccagcgcgtgcatggtgcgggtttccgtttcgcgcggctcgataaagcgcagcggctcggggattggcacctggaagataattatctgatcttcggtcagcggcgtttcggggatgcggtgacgcgtctggataaccgtcgcatcgtccgtacgttccgtggtgtttaccccggtcacgcgcttgaagaagttgcgaatcgacacggcgttggtggtgtcatccgcgccctggtcaatcaccttcagcacgtcgctttcgccaatcacgctggcggtaagctgaatgccgccggttccccagccgtacggcatcggcatctcgcgcccgccaaacggcacctgataaccggggatcgccaccgcttttaagatggcgcggcggatcatgcgtttggtctgctcgtcgaggtaggcaaagttgtagccgctcagattagccatggttctgctcctgttgcagacgtttgagtagctccagttcggcctggaaatcgacgtagtgggggagtttgaggtgtgagacaaagcctgcggcttcgacgttgtcggcatgtgccagcacgaactcttcatcctgcgccgggcctgtcgcgtgctcgccgtactccggggcttgcagagcgcggtcgaccagcgccatcgccatcgctttgcgctcgctcatgccgaacaccagcccgtagccgcgcgtgaagtgcggcggctcacccggcgggtcgataaaaccgttaaccatttcacactcagtcatcagcagttcgccgacgttcaccgcaaatcccagctcttccggcacaatcgacacgtcgatatagccgctgcggatctcgcctgcgaacgggtgattgcgcccgtaaccgcgttgggtggagtaggccagcgccagcaaatagccttcgtcgccgcgcatcaactgctgcaaacgggaggagcgtgagcaggggtaaaccggcggcgtgcgggtgatgtcatccggctgtgcgccgctatcctcttcaaacttcgccagcccctgacgcgccagcaggctgaaaacgtgcggcgacggctgctgttcgctgtcggcggtggtcagcgtcggcgcttcgccgtttgccagcagggtaaaatcgagcaggcgatgggtgtagtcgtaggttgggccaagcagctggccgccgggaatgtctttataaacggcggagatacggcgttcgagacgcatcccggtggtgtcgagcggctcgcttaccgccagcttcgccaacgtggtgcggtaggcgcgcagcaggaaaatcgcttcaacgttatcgccgctggcctgtttcagcgccagcgccgccagttcgcggtcggcaatgccgccttcggtcatcacgcgatctaccgcgaggttaagctgctgttcaatctgggcgacgctcagttcgggcaaatcggtatcgcctcggcgtcggctctcttgcagggcgtgggcggcgtcgatcgccttctcgccccctttcacggcaacgtacatcagcacacctccacatgagtggttcgcggaatagccagcaggcgctcgccacaggtcaggatcaggtcgatgccgagcgggaacggatgcgggcgctcggtgagttcgtgcagaatgcactccggcagctgcggagcgatcattcgttcttcggcaatacccgcaccagtaaggcgcaacatgcgtccgccgctcaggctggcgacctgtaaaatcagcgtcgcacccgcttccggcgcaacggcggtgccggtggaaagggcgttgagctgttcgctggaaatcgcctcatccgtcaccgcgaaggtcgcctgttccggctggctgaccagcggcgcgttggtatgaaaacgcaggctctggttgacgatatcgttatttaatggggtagaaagccacaccggcgtgtcgttatcggccagcgtcagcagcacgctggtggtggcgatattcagcggttgccagccgcgtttgagctgatgcagggcgacaatcacgcccggctcgctcatggcctttaacaggcgacgaaaactgtgctgggcatcctgcacgggaagcataaaagcggtttccagggtcatgcgttgtctccgcgaaccatcgtaaagaagtcgacccggctggcgttcacttcggcctggcgtgcggcaatgcgtgccatacggtcagcgtccagcggggcaataagggtttctgataagttttgaaagtggcgagattgctgcatcagcgcgtcaatcagcgcgcagcgttcggcgtgctgtttatcacgcccctgcacccagctgtagccgagcgtgccgtcagtcaggcgcacggcggcgcgggtcagcgtggcgtcgccggcaaaaaaacgttcgccggtgccgcccatccgcgcctgaatctgtaccaggccagtttcagcggcgcggatcacctcatagtcggcggtgatgtttagcgcgttcaggcgtgctgccagttcagccggttggctgtgcgccagcacggacatccagtgctggcgggtcgcggtatctgcgtgcattcagtgctccatagtgaattcaatcatgtcggcgcgcgtcaggctgacggagtactccgccgggctgctttcaccgtcacggtggttaagggtgcgcacgcacagcagcggcgacatattcgggatttcaagacgctggcactctttggcctgggcgcggcgggcgctgatccgcgtctggctgcggcgcagcgcaattccggtttgctcgcgcagaaaatcgtgcagcgagccgctgtcgaagcgttgcagcgtcggccagagggtgaggtccgcgaagtagtggtcgattaaacagagcgcgacgccgttgacacgacgcagggtgcgcaggtggatgacgttctccccctcggtaatccccagtgcgtcagcgacgtggccggacgcggggcgcaataccgaaagcagtttttcgctggtgggatggctgccctgatccagcagattctggctaaaacgcgcctgggcgttgagcgggtaatcgaacgggcgcatcagcaccagcacgccgacgccctgacggcgctgtacccagcctttttccaccagttggtcgatggcgcggcgcagggtgtggcgattcacctcaaagcgcgctgccagttgctgctcggcgggaagatagtcgccgcagcggtagtgttgacgaagctcctgctcaagttttgcggctatctcttgatagcgtgttgggtagctggtcggatgtgtagacaagtgcatagatatcaatgcctcgcttatcagataaagtgcttacgcaaccgttgagagaggaaatccagcaggctgaccgtgacgatgataagcaccatcagggcgcaggtttgttggaactggaaaccgcgaatcgcttcccacagggtgacgccgatcccgcctgcgccgaccatgccgacgacggtcgccgagcggacgttggattcgaagcgatagagggagtaggagatcagcagtggcatcacctgtggcagcacgccgtagaggatctcttcgagcttgttggcaccggtggcgcgaatgccttccaccgggccgggctcaatcgcttccaccgcttcggaaagcagcttggagagcacgccggtggtgtggataaacagcgccagcacgccagcacgccagcgaacgggccgaggccgacggcgaccacgaacagcatggcgaagaccatttcgttaatggcgcggcaggcgtccatcaggcggcgaacgggctggtaaacccaccacggcaccaggttttcggcgctcatcaggccaaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccgtctttgatcagcgtaagcggggccatttccgcgccctgccacgagacgaccaacacggcgagtacaacggcccagctcagaagcgagaaccagctgcgcttgggtggggcgatggtgatggtttgcatgtttggctccggtctgtaggccggataaggtgcttgcaccgcatccggcatcaacgcctgcacattgtcggatgcgacgccggggcgtcttatccgacctacgatttactgcaccgctttactcaccgaactcatcgcgcttagcgcgttgttcaggcggtccaggtcatccagctgcgcctgaatctcggtggtttttgccagcttgtcctgctcattcagtcctttattgcttttcacgccctgcatctctttaaacagcgcgagctggcgaatcggcaccagttgcaggtcgctggaagcgcggaatggcgcccagcccaggcgttccagcaccgctttttcttccggcgttttgccgtagttcataaagaagtcgtagatcttgtctttggtggtttcggaaagattcttgcgccagacgatcggatcgcctgggatcagcggcgacttccagatcaccttcagttctttcagcttctctggcgcggaggttttcagcttgtcgaggttttcggtgttgttggtggcaacatccacctgcttgttggcgacggccagcgcgttggtttcatgcccggcgttgacggtgcgcttgaagtcgctggcggagatattgtttttggcgaagacgtagtagccggggacgaggaagccagaggtggagttaggatcgccattgccaaaggtgagatctttccgcttcgccagcagatcgttcaggttgttgatcggactgtctttgttgacgatcaacacgctccagtaacccggcgatccatccgccgcgaccgtctgggcgaagacctggccattggcgcgatccaccgcttccatcgccgacagattgccgtaccaggcgatatccactttattgaagcgcatcccctggataatgcccgcgtagtccggggcaaagaaggcgttgaccttcacgcccagcttcttctccatatcctgcaagaacggcgtccattgcggtttcaggttttgctgtgattccgttgaaataatgccgaaattcaacgccttttcctgctcttcggcgtgcgccgggcttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgctgccgtcgtagaagacgtgcccctggcgcagggcgacgatgcgttcgcagtagcgcagggcgtaatccacctgatgcagcgtgacgaccacggtgatgccgtcgttctggttgatgtcgcgcagggtgtccatcacgatgcgcgctgattctgggtccagcgaggcgatgggttcatcggccagaatcactttcgcctgctgcatcagcgcacgggcaatcgccacacgttgctgctggccgccggagagggtggaaacgcgctgatgggcaaaatgcaccatgccaacgcgggtcagcgcctgtaacgcgcgctgtttctgctcgccggtgaaccagctaaaacaggtgcgccagaacggcgtgctgccgagcgcgccaatcagcacgttctccagtacgctcaggcggttcaccaggttgaattgttggaatatgtagccggtatgggcgcggcttttgcggatatcgcgggccaggcggccttcgcgctggactgtgcggcccagcagctcgatatggctaccgacagatttatcgccggtaatcaaaccgcttaagtgacgtaaaagggtggattttccggaacccgacggcccaagcagagccaccatttcaccgtgatgaatgttcagatcaaccgcatgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggcgggcctcccggcgggttattgcgttggttgttgtttgacgacattaatcatccacggtacgccaaatttatcggtgactttgccaaagccatgcgcccagaaagtttcctgccaggccatttcgatttttccgttagcggcaagattgtcaaaccagcgttttccttcttcgacctgttgcgaatcgagcaccagcgtaaagccggagtagctggcttttcctgacggcatggcatcgctcatcatgatgtcgcttccggcaatgcgcacattggcgtgggcgatggcggtatcgggaaattgcattccggaagggcagttctcggcgctgtcctgcgctgattttggcatttcgccgaagctgattttatagagcagttccgcgcccaacgtacgttgataataggcaatcgcgtcggaacagttaccggcaaaagagaggtagggacttaacggcatgatggtgacctcagttaagagaagccagttaagtgtagttcgaaatttatacagatgagaggcggcctgataagacgcgcgagcgtcgcatcaggcagtcggcactgttgccggatgcggcgtaaacgccttatccggcctacggagggtgcgggaatttgtaggcctgataagacgcgcaagcgtcgcatcaggcagtcggcaccattgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggatggtgcgggaatttgtaggcctgataagacgcgcaagcgtcgcatcaggcagttggcactgttgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggagggtgcgggaatttgtaggcctgataagacgcgcaagcgtcgcatcaggcatctggcaccgttgccggatgcggcgcgagcgccttatccggcttaccgatcacaatacaatcagttctttttcacaaactcagatttcagtttcatcggaccaaaaccgtcgattttgcaatcgatgttatggtcgccttcaaccaggcggatgtttttcactttggtgccaattttcagcatcgaagagctacctttcaccttcagatctttaatgatggtaacgctgtcgccgtcagccagcagattgccgttagcatctttaacgatcagctcgtcgctttcctgtgcaggttctgcgtcgttccattcgtaggcacattccgggcagatgtacatgccgttatcttcgtaggtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagacgacgatcgttttcatttgaaaggaaacgcaaaaagaaaataatctttttgcctctatttattatttaagataatgttaatgctctacttgttctttttttaattcacatgatatttttatctttctgacgttttaaacgtatcagaagacgttatttattctgataaaaaacaacacactaaatataaaattatttcttgcagtaattataaaagccgaaaacagaactcaaaaacaatctggctaaataaaataacaaaatttgctttaaggaagaattttctatgtacacacagaccctgtatgagttaagtcaggaggctgaacgcctgttacagctttctcgccaacagttgcagttactggaaaaaatgcctctctctgtacccggagacgacgcgccacaactggctttaccctggagtcagcctaatatcgccgaacgtcacgcgatgctgaataatgagttgcgtaaaatttcccgactggaaatggtgcttgcaattgtcggtaccatgaaagcagggaaatcaaccaccattaatgccattgttggtacggaggttctgcctaatcgtaatcgcccaatgactgcgctgccgacgcttattcgccatacgcccgggcaaaaggaaccggtactgcatttttcacatgtcgcgccaatcgattgtttaattcaacaattacaacagcgcctgcgtgattgcgatattaagcatctgaccgatgtgctggaaatagataaagatatgcgtgcgcttatgcagcggatcgaaaatggcgtcgctttcgaaaaatattatctgggtgcccagcctatttttcattgtctgaaaagtttgaatgatttagtgcgactggcgaaggcgctggacgtcgattttcctttttctgcttacgccgccattgagcatattcccgtgattgaagtggagtttgtccatctagcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcgattttggcggtggggcaatcggtgccgctgtacgtgctggtcaataagttcgatcaacaggatcgtaacagtgacgacgccgaccaggtgcgggcactgatttccgggacgctgatgaaaggctgtattacgccacagcagatatttccggtgtcgtcgatgtggggctacctggcgaatcgggcgcgctatgagttagccaacaacggtaagttaccaccgccagagcaacaacgctgggtggaagattttgcccatgccgcgcttggcaggcgctggcgtcatgccgatctggcggacctcgaacatattcgtcatgctgccgatcagttgtgggaagattcgctgttcgcccagccaattcaggcgttgcttcatgccgcttacgctaacgcctcgttgtatgctctgcgatctgccgcgcataaactgttgaattacgcgcagcaggcgcgggaatacctggattttcgtgcgcacgggttaaacgtcgcttgtgaacaattgcggcaaaatatccaccagatcgaagaaagtttgcagctattgcaactcaatcaggcgcaggtgagcggcgagattaaacatgaaatcgagctggccctgacctccgccaaccactttctgcgtcaacagcaagatgcgctgaaggtgcagttagccgccttgtttcaggatgattcggagccgttaagcgagattcgtacccgctgtgagacactgttacagacggcgcagaacaccatcagtcgcgactttacgctgcgttttgccgagcttgaatccaccctttgccgggtgttaaccgatgttattcgccccattgagcaacaagtcaaaatggaattgagcgagtcagggtttcgtcctgggtttcattttcctgtttttcacggcgtagttccccacttcaacactcgccagctgttcagtgaagtcatttcgcgccaggaagcaacggacgagcagagcacgcgtttaggcgttgtgcgtgagactttttcgcgctggttgaatcagcccgactggggacggggaaatgagaaatcaccgacagaaacggttgattacagtgtgttgcaacgagcattaagcgcagaagtcgatctctattgccaacaaatggctaaagttctggcagagcaggtcgatgaatctgttacggcaggcatgaatacttttttcgctgagttcgcttcatgtttgacggaattacagacgcgtttacgcgaaagtctggctctgcgtcaacaaaatgaatcggtggtcaggctgatgcagcagcaattgcagcagactgtgatgactcacggctggatttacaccgacgcccagctgttacgcgatgatattcaaacacttttcacggcagaacgatattgaccaagacgttacttgacggccccggtcgcgtgctggagtcggtttatccccgctttttagtggatctggcgcagggtgatgatgcccgccttccacaagcccatcagcagcagtttcgtgaacgactgatgcaggaacttctttcgcgtgtgcagcttcagacatggacgaacggcggcatgttaaatgcgccgcttagcctgcgtctgacattggtggaaaaactggcgtcgatgctggatcccggtcatctggcactgacgcagatcgcgcagcatctggcgctgctgcaaaaaatggatcaccgccagcactctgctttcccggagctcccccagcaaattgccgccttgtatgagtggttttcagcccgttgtcgctggaaggaaaaggcgttaacgcaacgaggcctactggtgcaggcaggtgatcagagcgagcaaatttttacccgctggcgtgctggggcgtataacgcctggtcgttgcctgggcgctgttttatcgttctggaggagttgcgctggggggcatttggcgatgcctgccgtctgggaagcccgcaagcggtggcgttgttgctgggtgatttgctcgagaaagcgacacaacatctggcagagagtatcaatgcggcaccgaccacgcgtcactattaccatcagtggtttgcctcttcgaccgttccgacgggcggggagcatgctgattttttaagttggctgggaaagtggaccacggcagataaacaacccgtttgctggtcagtgacccaacgctggcaaactgtcgcgctggggatgccacgactctgttcagcgcagcgtctggcgggggcaatgctcgaggaaatcttctctgtaaatttggcgtaaataatcagttacatcaatgagtcctaaacgaaatccatgtgtgaagttgatcacaaatttaaacactggtagggtaaaaaggtcattaactgcccaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcacttgccactttctccgttccctttctgattcgaccgcttggcggactcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcgatatttgttgcggaatactcccctgaccgtaaacgtggctttatgggcagctggctggacttcggttctattgccgggtttgtgctgggtgcgggcgtggtggtgttaatttcgaccattgtcggcgaagcgaacttcctcgattggggctggcgtattccgttctttatcgctctgccgttagggattatcgggctttacctgcgccatgcgctggaagagactccggcgttccagcagcatgtcgataaactggaacagggcgaccgtgaaggtttgcaggatggcccgaaagtctcgtttaaagagattgccactaaatactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgtccagccggtgatgggcttgctgagtgaccgttttggccgtcgtccgtttgtgctacttggtagtgttgccctgtttgtgttggcgatcccggcgtttattctgattaacagtaacgtcatcggcctgatttttgccgggttactgatgctggcggtgatccttaactgctttacgggcgttatggcttctaccttgccagcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcaaatcgtccgttgaaaggtgcgacaccggcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataagctgaaacggatggcctgatgtgacgctgtcttatcaggccaattgaactcttaaggttcacttaatctctgacgcgcatactctcctccaggttaacggaggagagtgcaatgaaaaaccgtgtttatgaaagtttaactaccgtgttcagcgtgctggtggtcagcagctttctttatatctggtttgccacgtactgatctttcttcagccgtacccaggcccgcgtgccggaagtctcttgccggttttgcaggaaaaactgcccgtgatgcaactgtgtaatgcggctgacaatacttaaccccagaccaatcccgccataacggctgtccatacgtacaaacgctttactcaactccccgcatttactctcatcaatacctggtccttcatcttcaactgccatgaccgctccgtcatcttcttgcagcttaatcataatgttgctgccttgcgggctgtaacgatgggcgttttctaccaggtttcgcaataacatccgcagcagggttgcatcaccctgaacggtgatgtcggcggcgctctctggcaatagcagggtttgctgtcgctggtcgagcatggtactgagttcgtcatacgaggggagaatgacatcttccagcagttttacatgttgataattaccggaagaaaatgactgtccggcacgcgccagttgcagcagctgggagacgctctccatcatctgatcaagccgtgccactaacggtgctacatcaatgtgatgcgttttcgccagcagttccagatgcaaacgcacccccgccagtggcgttcgcagttcgtgcgcgacgtcagcggtaaacaacctttcgttatccagcgtgctggtcaggcgactgaccagatcgtttaacgccgaaaccaccgcttcgatttcgagggtggcgctgtgaatggcaatgggcgttaagttgtcggcggtgcgcgcttccagctctttttgcagctccgccagcgggcgggtgatgcggcgtaccgcctgatagcagataaatagcgtcaggctgaccataaagacgccggggacaatcaggctggcgaccgcctcgcggatctcacgcatgatgtggcgatcgttgttgcgattgtcgcgtagcgcctgctcaaacagctgaatctgctcggtactttcatgccatagccagaagacgctgatcagctcaaacaccaacaaaatggccccgatggtcaatatcagccgttggcgcagcgatattggtcggcgcagaaaatgcatcagattcaattagttttcctcattcgcgaccagcatatagccaaagccgcgcacggtgcggatacgggctttgcccactttgtcgcgcagattgtggatatgcacttccagggtgttggtcgagggttcattgtcccagttatagatgtcgttgtagagaatttcccgatgcaccggactgcctgctttgagcattaaccgtgacagcagagcatattctttgggcgtcagaatcaactcttcaccgcccatccatacctgacggcgacccatgttcagcgtcagattgccaacaatcagctcactttcgccctgattattatggcgtcgtagcagggcgcggatacgggcatgtaactcttccagcgcaaaaggcttcaccagatagtcgtcggcaccgacatccagcccggcgattttgtcggtcagcgtatcgcgagcggtgaggatcagtaccggcagggtatattttttctgccggatacgggcgagaaaatgcagtccatcttcgtcgggtaaccctaaatccagtaccaccaggctgtaatgacctgcctcaaggctttgttccgccatccgcgcggttgtcacgctatcgcacgcgtagccttcggtttgcgccgccagaatcagtccctgcaataacagcgtatcgtcttcaacaatcagaattttcattcactcactctcctgcaagtttgcagaatatcatccgcagcctggtaatacttcgtctcaacgccagttaatcccaatagcgtggagaataaattgtcttgtgaatagtgttgcgtttgcgcctgtttttgcaggcagttctggtcaacctgataccgtttttgataatcctccgacagccacagcagcatcggcacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctctttggtacaggtctggatctcattggtgtcgcaggttggggtaaatttcctgaactgaggcggatagcggttgtaataggtcggaccgtggctgccgatggtgtgtaagacaatcacgccatcaccttgcaggttattgatgtactcttcaagcccgtggaacagcacttcgtcatagcattcgccgttgatgcactgatcaggtagattcagcgcggtgacgttctggtgaggcacgcggtcgcaggcacctttacagccgccatcgttgtcattccacagcacgttgatgcccgctcgctgaatgatatccagcacgccttcctggtgctgtgccagctcttctttgtagtgctcacgcggcatatccgagaacatgcacggtactgaaactgccgttgccgtgccgcaagatgcggtattagggaaatagaccacgttatctttcgccagccgcgggttagtttcacgcgggtagccgttgagggagaagttctccgcccgcgaggtttcgccgacaatcaggatggtcaaatttttacgtttttcgttctgcattaacgggttgcggtgcgcgtcttcaccaattcgcaccagcggcagatttgccagtcgctgatgggagtaccatgaccagctggcaacaatgctgttagaggggcttaaggatttcaccagctctttgttattgcggaacaacgaggcgtagtctttataaaacagtgcggcgaccagcaaaatcagtagtacagaaaccagaatattggctccacggaaaagaacactgcgcagacgcgaggtggcaggtttgatttttatccagcaggcaatcagcgcagcaagcacgccgctgaatcccagcgttaataacatttgcggtgtcatcagcgcataactttctgccggagtggtatcaataatattggcaatcatcgagcggtcgatgacgatgccgtaagtcattatgaaatattgtgcagccgcgccaaccagaataaacaggcaggccagtggtcgattaagccataagaaagagcttagtgtcaggacaatattaatcacgctgaaagcgacgaccggcatcgacaagaaaaccagtacgttatgcagcgaatccagcggcagcgcctgcaacacctgtttaaaaaaggcaatattcaggcagatagagatataaaaagcggccaacaatagccaggcgagtaaattcaaagagggtctttttagtaggcgcttcaacatcacggtgtttccatcgaacaaagtgcgcatatgctcgcaaagcaaaattaagccaaccttaagttcttaaggttggcttttatgtttgctggattaaggggaattaatctttgcttattggtgcatctaagggatacgggtttttatgtagccggttgtaattcagcgcatacatggcggtgatgaccatcagggtgacaaatgaccacataacctctttcgctccggaccccaccacggcccagatgcagtagaggaaggcaatggtagtaactgccagatatgccgggcgtgctttaccaaagtgaccgtgtccgagcagcagtaacgccgcacaggtgtaaagatatggcaccagtgtaaagatgaccgagacggaagaaaccagaccgaactctttggtcgcgtttggtgaaatgctgctgagctggaagatggtcatcaaaataccgacgataatcagccccgccactggcgtacccgctttatttacacgggcaaaaatcggtgggaacagtccgtcatcggcagcggctttcgccgtttgacccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcggcaatcaataccccaccaatggtggcgatagggacattgcgtttcgggtttttcaccacacctgcggcaacggaggcactttccacaccgatgaacgaccacagcgtaacgttaagggtactttgaattgcaccgaaggtgcccaggccgctgacgttccatgccgccatataggtttcaccacggaaccagaaccagccaaatacggcaatcccgacgatggggatcagcgccagcacggtggcaactgcctgcacacgggtgatcattttcggaccgacaatgttcagcaggacgaagatccacagcaccacgacgcaggtgatggttaataccaatggatctttcagaatcgggaagaagtaacttaaatatcctacgccaatgaccaccatggcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagtgcaccgataatcgtcaccaaccatccataaatggcaatcccgccagtagaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcgaccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcaactttttctttaacagacttgggctaagacataaacaactggctaccatactaagattccagtctttgtgaatatcgctttcaataatttgataaacgctgtcacttacacaattacgtaacatatacatcattaatgaaacgaattttttactgtcgagaaaacgggatagcaccgtgaataataatgcgcgtgttcgttccttttctgactcagtttctgcgggcatcatgctgtgttgcgcggcaacgcgaaagacgtctggcgtcaggcatggcagggtgagtatgggcgtagcgctacgttgccatactggtatttgcgagagatctttattcagaaaccggaggtaatctttgatgatgtcgtgactaatatgagcaaccaaagtgttgttaagagaggagacgtcgataatattattttcacaatttaataacgccatatggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcaaagcgataccgggaaatggttatataattgtatgatgaatataaacatgcataaaaataacgagttttactaatagtacaaatttttatagtaatttctcatgtacatatttttttacaggataaataacaggcaaaaaaaagcgcggggtggggccgcgcaaaaagtatgacatttttgtttgcagcaatttttatgaaaacgttgccatactcaaaaggcctaaggccaggcggcgtaatgttatttaaacaattacgccttcagcggaatagtggttacgctttcacgcacataacgtggtaaataccgtcaataatttcagtcccttcagtttcgtgttcaaatccagggaaatggtggtcccaggattgcagcgagcgtaaataacttacttgcggactgtttttatcgccgaagttttcaccagacagcagcatcgggattcctggcggatacgggataactgagtttgccgcgatgcgtcctggcagattttcaatggataccagttcgacattgttgtcgacaatcgcgttgtacgcttcacgcggggtgacttccgccaccggcaggccggaataggcttcgttcaaccgtgcgccagggttgttttctttcagccaggcaaacatggtgtcacccagatcgtgaatccccatgttcgcgtaagtgtcaggatattgttcaacaagttccggcatcacctgcgccagcggtgtgttggcgtcatagtggcgtttgaaggagcaaagggtgttaaccagagttccccatttcccacgggttacgcccatagagaacaggaacataatttggaagtcagtggtgcgggtaggtacaatgccgtggcgaccaagccaggcagtgaccagcgccgccggaacaccggtttcttccagttcaccatcttcacccattcccggagcaaggatgctgactttaatcgggtcgagcatactccagttatccggaatatctttgaagccgtgccagctttcgcccggatgcattacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatatagccgcgccatcgcctgacggaaatcaaccgcttcgtcaatcacttcctgtgtcagtgacaggccgctgttgccgtccatcatcgacaccgccacgtcgttggatgcgcagatggcatacagcggggaggtggtggcatgcatcatgtaggcctggttgaagcgggagaagttaatcgccccacgaccttcacgtacatgaatataagaagcctgtgacagcgcattcagcagtttgtgggtggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgcgcttctttagcgttataacacacgccgtcataggtgcagttggtcaccacgcagtaagacggtttttgcccggctttgtctttggtcagcgggctttcactgattttcttctgcaaggtttcaggttgcatttcctgcggatagattggcccgataatgccgtagcggttgcggcttggcaccatatagaccggtttcgcgcctgtcagcatcaaaccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatttttcgctttcgccaaatgcgccagtatggtcaagcaaagaaccgagggaagttcgttcgatgcccatgtcggtgcggaacagattttcaccatagtagtcatggtagaaacgtccggcgggtgttttggtaaaaccaacgccgccctggtggcctggcgctgcccaggaatattcatggatgtcactatatttcatcagcgcgctgaacagtggcggcaacagctgctggcggtagcgggtcatcgcggcaacggcgcgtccggcgataaagtcggcggtatcttccagaatccaggcgaattcatcgacaagctccagcaggtcgcgatccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttgaaatatttagttttataaacaatacgttatgtgattattttaaattattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacgactacttgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctaacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttcggactgtttaattcctgctgccagcggcgcacttcaaacgggctaagttgctgtgtggccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatctccatccgctggtattccgaatacagcgacagcgggctgcgggtctgtttttcgtcgctgctgcacataaacgtatctgtattcatggatggctctctttcctggaatatcagaattatggcaggagtgagggaggatgactgcgagtgggagcacggttttcaccctcttcccagaggggcgaggggactctccgagtatcatgaggccgaaaactctgcttttcaggtaatttattcccataaactcagatttactgctgcttcacgcaggatctgagtttatgggaatgctcaacctggaagccggaggttttctgcagattcgcctgccatgatgaagttattcaagcaagccaggagatctgcatgatgtctgcacccaaaattacatttatcggcgctggttcgacgattttcgttaaaaatattcttggtgatgtgttccatcgcgaggcgctgaaaacggcgcatattgccctgatggacattgaccccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttggggccgggcggtattatgcgcgcgctacgtaccattccgcatctgtggcaaatttgcgaggacatgacggaagtctgccccgatgccaccatgctcaactatgttaacccaatggcgatgaatacctgggcgatgtatgcccgctatccgcatatcaaacaggtcgggctgtgccattcggtgcagggaacggcggaagagttggcgcgtgacctcaatatcgacccagctacgctgcgttaccgttgcgcaggtatcaaccatatggcgttttacctggagctggagcgcaaaaccgccgacggcagttatgtgaatctctacccggaactgctggcggcttatgaagcagggcaggcaccgaagccgaatattcatggcaatactcgctgccagaatattgtgcgctacgaaatgttcaaaaagctgggctatttcgtcacggaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaaagcctcccggattgatattaaaccgtcacgggaatatgccagcacaatcatgaacgctatctggactggcgagccgagtgtgatttacggcaacgtccgtaacgatggtttgattgataacctgccacaaggatgttgcgtggaagtagcctgtctggttgatgctaatggcattcagccgaccaaagtcggtacgctaccttcgcatctggccgccctgatgcaaaccaacatcaacgtacagacgctgctgaccgaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaaaacgcgactaaacgctactgcgccgggggatttattccggcgcacacctctgacgataccaataacagaaggcgggcgttggtaacagcgacccgataccctatgagcatttcaatgactacaaaactcagttatggatttggagcgttcgggaaggattttgcgatcggcattgtgtatatgtacctcatgtattactacaccgatgtcgtcgggctgtctgtgggtttggtcggtactttgtttctggtggcgaggatctgggatgctattaacgatccgattatgggatggattgtaaatgctacgcgatcgcgatggggtaagttcaaaccctggatcctgatcggtacgttggcaaactctgtaatcttatttctcctctttagtgcgcatctgtttgaaggtactactcagattgtctttgtttgcgtgacctacatcctctggggcatgacttacaccattatggatattcccttctggtcgctggttccaaccatcacgctcgataaacgtgagcgcgaacaactggttccttatccgcgtttttttgccagtctggcaggctttgttacggcaggtgtgacgctaccatttgttaattatgtcggcggtggcgatcggggatttggctttcagatgttcactctggtactgatcgccttttttattgtttcaaccatcatcactctgcgcaatgtgcatgaagtcttttcgtcagacaatcaaccgtctgctgaaggaagccatctgacacttaaagccatcgttgcgctaatttataaaaacgatcagctttcatgcctcttgggtatggctcttgcttataatgtagccagcaacattattaccggctttgctatctattatttctcatatgttatcggtgatgcggatttgttcccctattatctgtcgtatgcgggagctgctaacctggtgacgttagtattcttcccacgcttagttaaatcattatcccgacgcattttatgggccggagcatctattcttccggtgttaagctgtggtgttctcctgttaatggcattaatgagctatcacaacgtcgtcctcattgtgattgcgggtattttgctgaatgtgggaacggcgcttttctgggtattacaggtcatcatggtggcagatatcgttgattacggtgaatataaactgcacgtacgctgtgaaagtatcgcttactccgtgcagactatggtggtgaagggcggttcagcctttgcggcttttttcattgcggttgtgttagggatgattggctatgtaccgaatgttgaacagtctacgcaagccctattaggtatgcagtttattatgattgctctaccaactctgtttttcatggtaacgctgattctctacttccgtttctatcgcctcaatggtgacacgctgcgcaggatccagatccatctgctggataaatatcgcaaagtaccgcccgagcctgttcatgctgatattccggtcggtgcagtgagtgatgtgaaagcctgacgtggacaatagctaacgaaaatggcctgatgcgatatgtttatcaggccacgtcttaatgtaatgctttggatttgcaaattttgtagaccggataaggaattcacgccgcatccggcatcaacaaagcgcaagttgttatccggttatcaagccaaagcgccgtagctggcggcaatgaaagcgagcgaggaatatcaccgtcgttaatgcgccaagcagcgcgcagaacatatcggattgcgtgtcccactggtcgccctgggtgccgagaaaatcatccgctccctgacccattgccagcgctgcccaccactcgattaattcatacatcgcgcttatcgccagcgccacgcagcagaccaggaacgccaccattttacgtccgcgcacgtacatcccgcgaacgagaatttctcgtgccaccagtgcaggcaccagcccctggaaaaagtgccccagcttgtcatacggattacgactcaaccccagccattcctgcacctcaaaaccaacggggactttcgcgtaggtgtattgtccgccgaccatcaggatgatggcgtgaaggaaaatgagcgtatagagcagcggcgttaacggataacgtctggcggtggcaagcagtagctgcacgacaataatcaccggtgtcacttccatcagccaggtgagtttgtcatgggccgaaatgccggtataaatcaggattaacgttagcgtcagtgcgctggtgttaagaattaacggcttgagtgtgcgggtcatggtgagttcgcaaatcagggaaaatactgactattcaccagcaagcgtgaaattacaatcgcaaaagaggtggccagggggatcacctggcagcatgctgccaggcgctgggccgaagaggttacttagtgcagttcgcgcactgtttgttgacgatttgctggaagaagtcgttacctttgtcatcgaccaggataaacgccgggaaatcttctacttcgattttccagatagcttccatacccagctccggataagcgacgcactccagatgcttgatgctctgctgcgccagtaccgccgccggaccgccgatgctaccgaggtagaagccgccgtgtttatgacacgcgtcggtaacctgctgactgcggttacctttcgccagcatgatcatgctgccgccgtgggattgcagcagatccacgtaggagtccatacggcctgcggtggttgggccaagtgaacctgatggataaccggcaggggttttcgccggacccgcgtagtagatcgggtgatctttgatgtactgcggaagttctttaccggcgtcaatcagctctttcagcttggcgtgtgcaatatctcggcccacgataatggtgccggtgagcgacaaacgagtggataccgggtattgcgaaagctgggcgaggatctctttcatcgggcggttaaggtcaactttcaccgcttcgccttcaccggcctggcgcagttcttgtggaatgtactggcctgggttgtgttccagtttttcgatccagataccttcgcggttgattttcgctttaatgttacggtcagcggagcaggagacgcccatgccgaccgggcaggatgcgccgtgacgtggcagacggataacgcgaatgtcgtgcgcgaagtatttaccgccaaactgcgcgccaagaccgagtttctgggcctcttccagcagttcctgttccagctggacatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggagtcagcagggctttggtttcctggtagagatacgttttgttggcagagccgccgcctttcgcaacgcaaaggaatttgtactcatcgccatctaccgcgtacaggtcgatttgcgcaggcaggttagtgccggtgttgacctctttgtacatgtccagcgccgcattctgtgaatagcgcaggttatcttcgatataggtgttatagacgcctttcgacagcgtttcttcatcaccgccgccggtccacacgcgctggccttttttaccgacgatgatcgcggtgccggtatcctggcaggtcggcagcacgcctttggcggcgatttcggagtttcttaagaattgcagcgccacgtacttgtcgttttcgctggcttctggatcgtgaagaatagccgcaacctgtttctggtgtgccgggcggagcataaaagaagcgtcgtgaaaggcttgctgcgccagcagggtcagggcttctggttccactttcaggatggtttcgccgtcgaagtcggcaacgctaacgtaatcggaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtatgccggatcaacgccgatcgccagcgcgaccggaacaatcgccgccagcgccgcagcctgagagtttacaaacttggaaaccagcagcagaacaatggcataggcccacggatactctttcaccatttcacccagtacgccctgaatttcagacatatgcgcaccgaacatggtttctgccatccatgcgataccgtacaccgccacgatggcgatcataccggaacggaagacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgccccgaggaaaatccacattgccagccagttgcttttcggcagttttttatccagcagcgtcgcggtatcaccgtaaacatactcacggttttccggtacggagatgaatttctggaactcttcgtctttatccagatctttaccgcggaaccagctgaagataccgatcgccaggataccgattaacgtcgatggaatggtgattgccagcagatcgaggaactcaagatggcgaccatcaaaggtgacattacccagcatcgcaaccagagacacgaccgcaaccgacaccggactggcgataatccccatctgtgcaccgatagaacttgccgccatcggacgttccggacggatgttgttcttaatggcgacgtcgtagatgatcggcagaatggtgtaaaccacatgacccgtaccgcaaagaatggtcagtgtacaggtcacaaacggcgcgacaattgagacatatttcgggttgcggcgcagcagcttctcggcaatttgcagcatgacatcaagaccgcccgaagcttgcaaggtcgccgatgccgccaccaccgcaatgataaccagcatgacatcaactggtggtttacctggctgaaggtggaagacgaagaccagaatgaccagaccgataccgcctaataaacccagcgcgataccaccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggctttagcaaatacctcacagtgaatattggctgattaaagcagcggcaaatttatgcactgtgataagcggctttttcagagagaaagactctctggcgatgggtttatagtttgtactgcgcagatgttaatgttttgtttgctgttatcttattgatatttatcggtctattttttgttctcagggcagatgtcattaggtttatagattaatctgatctacccatttgtgggtaaaaatacacataatgcgggtgacataatagttaattaacttttgttagcgttttgaaattaaaaacaccgttcacctgaagagatattaatttttagcgatgatggagggataattatatttgatctggcacaagttttactgatgaaggatgtaacttgtgccaggggtattttgcattacggtaataattattacttacagataaccagcgatccgttattggcaatattgtttcagtagtgagtagtgttctgcctgaatacggtaacggtaaactggacgccccgtgacgccataatggatactggtgaacaagatgtggcagttgaccagccagatgaggtatttacggcaggaaacacgcgaaatgttaacctcgttggctagctcgtcggttgaaaattcatagtcctgatgcgcgtcaatccactggcacagtgtgcgtaacgtctgcggcgttaagccttttggcaagcgacgaggatcctgttcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacgacaccgtaatgcagcgaatctttaatggttgccgcatcggctgcggaggagatgacaatcacatcacttttgcaacgcgcgttatgcaggacaggcagtaaatcgagcccgttctctttttgcatatagatatcgagcaatatcaggtcgataggcgtatcgctattgaagataatctctttggctttctccagcgtcgaggctgttccacagcattgaaagcctgggatttgtgctacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttatcgggtgcgatccccggtccatcatcattaacttcacagtgcagccagccgtgacggtagtgcaatgttacgctaatttcgcctccgggttccggccctaatgcctccagcgcgttttctatcagatttcccaacgtggtaatcagcgtcgcgacctggtcctcactgccgctgtctggcagctggctttcactgtttaaaatcagcgtatggcctaaatcggtcgcgcggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcgtcagcatagttgaccagaccgtcgagtcgctgcatcagtttacgtacttcagttttgtccctgaaggttgaaatggcaccgatgataacgccattactgcgcaccggaacggtgttgatcagtaatagccggtctttaatcgtaatctcttcgtcgcggcgcggggtaccgtcgcgtaacacttccgagacatctaccacctgtgaccatgagtggcttagcgtcgacagtttctcatcgtcctgcgacttacggtaattcagcaattcttgtgcggcatcgttgatcagcgtgacctcgccgcgatcgtccacggcaacgacgccttctttgatagactgcaacatggcctggcgttgctcaaacagcgtggagatttcgtagggttccaggccgaaaaggatttttttcagtaccttaaccagaatgcaggtgccaatcagtccgaccagcatgccaaataataccgaccagataatgctccagcgactgtcattgatctgttgggtcacacggcttaactcaaggccgatcgccaccacgccaatttgtttatgattttcatcgtagatgggggtaaatacgcgtaaagcctgcgccagaaaaccgcgattgatagcgacattttcttcgccattcagcgctttaaggatgtcatcacctttaaatggctgaccaatacgctgggcttcaggatgcgagtagcgaagactttgcatatcggtaacgacaataaacagcagatcgttgcgtttgcgtacggcttccgcgatggcctggatgccactctcctgcggttttttctgcaagccctgacggatttccggcgagtcggcgagggtacgcgccactgccagtgccttgttggctagcccatctcgcgtcatatcactgatttgcgagaagtaaatcagatgcaccaccaatagcaccgagaacagtaccgcactgaccattaagatcactgtggtactcaatttcatcggacgtttgcgtaacatgcggtagggcaatgaatgtctcatcagcttccttgtgtgacaaatttcttaagcattatctctgatgaggcgggtaattcaaagggagtaagaatgattggctatataggggaagagactctggcaacggaaactgccagtgctgtatgaagattccggggctatgcttatagcgataatcatactgatgagagagggaaggtcatggatcaggcgctactggacgggggttatcgctgttataccggcgaaaagatcgatgtctatttcaacactgcgatatgtcagcattctggcaattgcgtacgtggcaacggcaagttatttaatctcaaacgaaagccgtggatcatgccggatgaagtcgacgtcgccactgtggttaaagtgattgatacgtgcccgagcggcgcgctgaaataccgtcataaataagcgagggtaaaatggaaatacgcgaaggccacaataaattttacattaatgacaaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccattatgcccatttgcgaaacatgaatttgataaaacgcgggagtatgatgatattcgcagttgatgggagagtacagagtcacgatatttttcattctctccgcgatgtgatgcaggagagcatctgaagggtagggggatgcacaaagaatgggcagagagcgcgtttttttgtcccaagtcatcccctttactgagcaaaaaaaagaatatctcctatatgagaatcatcaatcggggttaataagttttgcgtccccagagcgtttaatattgataggagtcatattatggaaggtaaaaacaagttcaatacttatgttgtttcttttgattatccatcatcttattcctcagtgttcttaagattaagatcattgatgtatgatatgaatttctcctctatcgtggctgatgaatatgggataccacgacaattgaatgaaaactccttcgcaataacgacatcgttagccgcaagtgaaatcgaagatttaatcaggctcaaatgcttagacttaccggatattgattttgacctcaacattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcattcctggtcggaataacctggccaatgagtctgcctgtggcattacttttttctctcttttaggagctgtagttgagtggacccgctggttatcgtgaaacgaagcgtctctcctcaaaactggatttgcggaacgatgaacgaagcagtcgcctgactgcttcgttcattaaagtgaaatttatttctgtgggcgcatcgccgggaagagaataacgtcgcgaatagtatggctgttagtaaacagcataatcattcggtcgataccaatacccagaccagcggttggcggcagaccatattccagcgcagtcacgtaatcttcgtcatagaacatggcttcgtcgtcacctgcagctttagcattaacctgttcctggaaacgttcagcctgatcttctgcgtcgtttaattcgctaaaaccattaccgatttcacgaccaccgatgaagaattcaaaacggtcggtgatttccgggttaacatcattacggcgtgccagcggggacacttctgccggatattccgtaataaaggttggctgaatcagatgtgcttctgccacttcatcaaagatctctgtgacaatacgtcccaacccccagcttttctctaccgtaataccgatagattcagctaatgctttagcagcatcaaaattatccaggtcggccatatcggtttctggacgatattttttgattgcttcgcgcatggtgagtttttcaaacggtttgccgaaatcaaacacatgctcgccataagtgactttagtggtacccagaacctcttgtgccagggtgcggaacagtgactctgtcagttcaatcaaatcgtggtaatccgcatacgccatgtagagttccatcattgtgaactcaggattatggcgaacagaaataccttcattacggaagttacggttgatttcgaatacccgttcaaaaccgcctacaaccagacgtttcagatacagctccggcgcgatacgcagatacatatctaaatccagagcattatgatgggtaataaacgggcgagcagatgccccacctggaattacctgcatcatcggggtttctacttccataaagccgcgcgcgaccatgaattgacggatagcggccagaatttttgaacggacaacaaacgtttgacgggatttatcgttagcgatgaggtccagataacgttgacgataacggacttcctgatcctgcagaccatggaatttatctggtaaaggacgtagtgctttagtcagcaggcgcagctcagtacagtgaatggaaagctcacccgtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccatgatacgacgggtcatcattcggccagcaaccgagacttcaatgtttaaggattccagttcctggttatccttcgcatcaaactcttcgtgcaactggtcagaggtatggtcgcggcgaaaatcattgggaaacgccacaccttgctgacgtagtgccgccagtttttcgcggcgatttctcagttcatcgttaaaatcaatagcctcattggctccccgtgtttcttgttcagacattttggttcctctaaatccagctttcaatttagcgtagataaagagacagatcggtacactgtattatctgcctcgactattagtaactcagtttatcttatcgaaactaacgcttacctcaagttgatatcactaataaataaccatcaaaatggtttaaatgacttattaatctcgatttgttagtgttataaactgaaagttaatttattcataaccaattgtttttacgacagttaatcgttgctctcctgtatcatattcgtcggcgtgctaaacagaaaacgggtagcaaaggccaatacgacgatgatcgcgacacaagccaacgtccactctcccatctgagaaaagaatcgctggtaagctgcaattgccataccgctaatttgcgactctgtcgtctgctgtgccacgacgcctgccagccagttggcgaccgcgcctgttgccagcatataaatcccggttaatacgccagacattttcagacgcgtgatttgcgcaatcgccaccgggtcaataaagagttcggcaaagcccattagcgccagcccggatatcatcacgcccattgacgcttgaccgtcagccgctgcatgtcgggcatcaaatgccaacaacataaagccacaagccatcagcagtaagccaaaggcaaacttcagccagacgcgcaatgttgagttgccgcggctttctggcgacgccagccaggccagtacaaccccagcgagcatcaccgcaattgcattcaccgactggaatagtgctgtaggtacttcaatattgaatgcctgacgattcacaaagcgatcgataaacaagctgatggtactgccgccctgttgtgccagtacccagaacaatgtcccgacaaacatcaacaatacaatttgccaaagagcacggcgatgttcggggaatttgatcatcatgcgggcaatgatttgtgcggcaatgaggcaaacgatcgccagcaaatatccggaccagtcgttctccagcagcagagtaaaaaatactggggctaaacagagcatcaccactaaccagctccatactggtaaggcaaatttgacactagtgagcgcttttttatccatactacgtgtggactggaaatgacgatgaccgcttaagaaaatcaacaaaccgataaacatgccgccacccgcaagggcaaagccaacatgccatccataccactgagcagccaggccgcaggcgattggggctgcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatacccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatgtgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcgggtacggaaggatcatattggcgttaatacgacctaccatttcgtcgaggtaaacttcttcggtcataccgtgcagctctttctggaatgcagcatacggagtcattaccatcgtcggcagcacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcaggtcgaacgcacgtttaaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatagaaccgttgatcagacgcttacctgcattgcctttcatcatcgccgcagcggtttcagtggacgccacgataccgtagtgcggagaagtggtggtgtgcatcatgtaggcttcgttaaaggtttcttcgtttacgtcacctttaacgtggatcatggaagcctgagagaacgccgccagcagtttgtgagtggactgggtttcgtaaatcactttcccttctacacggccaccgctcataccgcatttaccttcgtaaatcggtgagaagttggtgtaaggcacccacgcggagtcaaagtggatggatttcacatccagtgttttcttgatgaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgctggagcagagtacataccaacaattttgttcgcagtggaagtaccgttggtcaccatgtagctgcggtctgcgttaaagacgcgagcgatatactgttctgcttctttgtgtggaccactgtgatccagcagagaacccagttcagatactgaaatggaaatatcagatttcatggtattcggaccaaagaaatcatagaacaggctacctaccgggcttttctggaatgcagtaccgcccatgtgaccaggagtacagaaagtatatttaccttcacgaacatatttaaacagtgctttagtcagcggaggcagaatagtgttgatatattcgtcagtggtctgcttgatcttattagcaatatcttcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgcggtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaaatacggcagcatagtcagcagtactgcgataccggtcagttcaccgaacaggtcagatgctttaccaccggcagagttcatcagagtgataaggatcatcagggcagtcattttcactgcagccagcagcagaccttttttcggaataccgttgctgtcgacttcaccataaactttcgggaagttaccgtcgttagcggcacgtacacctgcctggcctaccaacatcatccaggagcccagagaagtcaggcacgcaaaggcggtgaatgcagaaaccagcggcgcagcccagttaccgaggatagttgaagcactgattgcaaacggagcaccggaagccgccattacagaagacggatacataccggaaagcacctgagtcgcagcgatgtaaacaatacctgctaaaccagtacccagcatggttgccagcggaacggtacgtttcgggtttttaaccataccagtacttacagctgcggattcaacacccacgaaggcccacaggcagagcagaatacttttaatgatcgcatgaccatcagtggtatccgcagtattccagttagctgcataagttgccgcatcaaaccaatgccagccaacaatagcagtcatcaccacaggaataagaaccagcaccagaccaatagtggttaaacggcttacccaagtaccgccgagcatatttacaaaggtaaatacccagacgatagcaatacaggcgatacccgccggaacaggatcatttaatactgggaagaaggtggaaagataagatacagcggtaataccaatcgccaggttaccaatccagttagcatggtaataaagaacacctgtctgaaaaccaaatgcaggggaaatttctccggcataagcaattgggccaccttgttgcgggttttttgttgccagtcgggcatatacatacgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgataagattactcacgaaaaaaggattaatcctaaagattaggtgaaataacacaaaagtttctgtaagtgagaacttgaggttttttattaacacatcaggatcgcaagttgatatcatgaaaagataaacatttaatgtttacaatggattgcgtgacattctctggttaaatttatgtaataaaaattatgcggcaaataaattgccgcaacatattataccaacaggaacatacaaaaactcaacaacaaatatttccgagcataaatcaacccggagttacttattctgaagcaagaaatttgtcgagataaggtacaacataaggaacagaagtctggaatataccattttcaatccagtaaagggtgtttgcccctgggcgtaaattaaaggcggtgagatatgcatcagctgcttcccggttcatccccttcatttcataaaccttgccaagcaacacataatttagccaggacatttcaagatcaatgccagtatttatcgcctggtaagactcatctgttttaccttttaccagagcactgaccgcttttatttgatatataatggacaggttgttcaattccggcagtgtaacaatgttatctatttctgtgttcagtgctgctaattgtttttcatctaaaggatgttgagaatggcgcacgatatcaactaatgctttttctgctctcgcgtaggtaaattctggggatgattgaacaatctcacctaataattcactggcacggttcaatgatttatcatcgccatgcagtaaataatcatgtgcctgataaaaattagttaataacgcaccacgatgcggcaaaattttctggagcgtctcctgcattcgttgtggccacggttggtttaacgcttttgataaactctccagtaaatcattttgaatcgccagctgattaccgttagtgatgacataacgtttatccagcatggttgaaccatctgcattgtctaccaattttatcgacataaagcattgttgagcacggtattggcgctgattaacaaacgcaatagataatgttttaccggaactgctcggttcatcaatgttgtagttgattttgtcatgcaccataaaggtggagaaggtgttaagtgatgtcgccaccaaatcacccacgcctatcgcgtaagagagctgatacggggaactccagctgttacaacttttatttaccatattaatgtcaatatcgcgtggattgagcaaaatacgcgatttgctcataggaagacgtgtatcaagacttgaaaacgctaccagtgctacacagatacctaacgacaacaggaaaaaaaaccatacccaaaaggtagtgaatcgtttgcttttaactggggattgttcaggtggcgttgcggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacgtgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccacaacctatttttaccatctatagatgggtttatttacatattattggtgaatgcaagacgttatttttaccagccataaacttcttgattacatagtattacgaaaggattttactgagaaccagaagtaatattccttaccatcaaaattcatcatctttgccaaagaaaaatgttcagaaaataatccatggaaaattgtccggagcacttactattttaatggattgttagtctttgcatgagcaagcgaactgatacatttctctttgttctcattcagaaaatctcatcagtcgccgttcagaccggtgttgtgctttatggatgcgttacgctcctgatgacgtcatttgacgttcaacagcatcacggggccgcacgacatttcacgtcagttagtgctatagctcaggaacaaattttcccgaattgggatatgcccgcaaattgctggtgatgtggggagaatctggttgagttcggtagaattgatttggaggcagaacgcttaaatcgtggcgtcctgaaacgaaaaacggacctccgtggaggtccgtttatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcaatgcaccaccctggcggcagcgggcgaagcgcaggatatcttccgccagccgatgtgcagtgtcgacatccgcctggctacgattcaccagcattcggcttaaacagccttccagcaccagttccatctgctttgctaccatcgccggatcgtcaacttccagtgtggttaacagttcgtgggtgaaatcgtaggccgcgcttttttgctgatcggccagttgatgaatagggtggccaggatcgggataaaacgtacaggcagcgataaatagacagcccggatagcggttgtttttaacgcactccgataacgcctgataacgtgccagcagcttttgttcggcggtttgcgtttcgtccagcatcagctgacgacgccagacatctatctgttggctaagataacgcagcgcatcgtagaggattgcctctttgtctggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggccgtgacgttggcctgaagtaagaccgtgtctgctaacgctttttgcacctgcgggtcgctgaaggtgtatttctcaaactctttacaggcgacgcaccagtcggcataaagatctaacatcaccggtttgcctttggcttcaacgagcgcctgatttaactcatctaccgttttgatttgtgtaaagttgagatgcgtctgagtttgcgcggtatgcgtcgcaccaaatgcccaatcctgaagtgggcgcacgctaaccaatgccgctgccagcagaataatttgcacaatacgcatccagccgcgtttagcctgtaggctggtgataaaggcccagccaaagaatgcgacacccagcgccgaccacaagcgtaatccccatacatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccaacgcatagagataaagcgtgccgccgcccagccacatgttcccgctttgggcgatatacagcagaatcgcgctaagcggtgcggtggtgcatggtgaacagatcagtccggcaatcgcccccataacaaacacaccgccaggtgagccgccctgttggcgattgctcatcaacgtgagacgtgtttgcagcgaagaggggagttgcagggtaaacaagccaaacattgacatcgccagcaaggtaaagacgatggcgaggccaatgagcacgtatgggtgctgtagcgccgcctggaactgtaaccctgcggcggcaaccaccagacccagcgccgtgtaggtcagcgccatcccctgcacataaataaaggtcagcaacaatgctctggcagtggagagccgctgtttaccacccagcacgatgccagaaatcagtgggtacattggcagcacgcatggcgtaaaggcgataccaataccgatcaacaacgcccagagcgcggaaaagggcaattgcgcggtgggctgctcttgctgcggaacagacacaggctgtggcgctgcgttgttggcgaccacttcgcttaacggaacggttttggtttctggcggataacagaaaccggcatcagcacagccctggtaggtgacagttaacgtcgctcccgcactcgcctggttgatggtgacgggaagcgtcagccgatcgcggtaaatctcgcttttgccgtaaaactcatcttcatgccagacgccttgcggcagctgcacgtcggcaattttcgcgtgttccggcgtaatgcggatctgtttacggtagaggtagtaaccgtctttgatctgccaggtcagattaaggtcatgttggttttgctgaaaatcaaaagcaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcagtgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatctggtgccgtacatagcaccacgacagacgcggtattcgaacttttttcatcaagcataaacacctcgcaagaacagatggaaccgcaagagagaggtcactatacaacggacgggggaaggatgttagtcggcgggaaagaaagcggggcgtgaacgccccgcgattgatcattacagcatgaagctacccagcacgaagccgaagcaaacggccagggcaacacccagagtacccgggatgaagaacggatggttgaagacgaatttaccgatacgggtagtacccgtgtcatccatctgtaccgcagcaaccagcgtcgggtaggtcggcagaatgaacagaccagacaccgcagcgaaagaagcaacagcggtcagcggtgaaacgttcagtgccagagccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgaggatgttgtcggtatcgactttacagataacggtggtcagagttgcaacgctgagcatgatgatcaggattgcgttggtggtgttcatcagcggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccaggaaggacatcaccagaaccgccagcagggtggacgggatgaccacggagagcagatggaggtagctgatgccatgaccttccatcacggaagacatgtaaaccactgccgctgagattggcgatgcggtgatcgcaatctgcgcggataccactgcagtagacagcggacggcaaggtttaacgccttgttccttcgcaacttcagcgataactggcagtgtcgccagagagatgttgccagtaccagcaaagatagtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggagatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattagattgttatttttaagttactgctcacaagaaaaaaggcacgtcatctgacgtgccttttttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgaccggctccataacgttcaactgcagctgacctgcttctgctgccatggtaacagtggtgtcgttaccgatgactttgaagcatacctggttaaccacttccggaacaaccgggtttactttagctggcatgatggaagagcccgcctgcagttccggcaggttgatctcgttcaggccggcacgtgggcctgaagagagcaagcgcaggtcgttacagattttggacatcttcacagccaggcgtttcagcgcgccgtgaaccataacataagcgccgcagtcagaggtcgcttcgatcaggtcttcagccggtacgcatgggaagccagtaacttcagccagttttttcactgccagcggagagtactctttcggcgtgttcagaccagtaccgattgctgttgcaccaaggttaacttccagcagcagttcagcggtacgttggatgtttttcacttcttctttcagcaggatgctgaaagcgcggaattcctgaccgagggtcatcggtactgcgtcctgcagctgggtacgacccattttcaggatgtcctggaattcgacagctttacgttcaaagccttcacgcagttggttaatcgcatctaccagcttaatcagggaagagtaaactgcgatacggaaaccggtcgggtaggcgtcgttagtggactgacatttgttaacatggtcgttcgggttcaggtactgatattcacctttttggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcgaccgacgattatcccctgcatcgaccgaatacccgagatcatatgctgcttgaggatttctaccgtaatctggatcactttaagtgtcggtttttaccccttaattattaatttgtgaaatagatcaccgctttgggattactaccaaaaatagttgcgcaaacatcttgaaattttgctaatgaccacaatataagctaaacgcgattcgcaacccattcaggtagccggggttaaccggctgctattacaggagaaacctttgcgctggttaccttttattgccattttcctttatgtctatattgagatttcaatctttattcaggttgcccatgtattgggggtattgctgaccctcgtgctggttatattcacgtcagttatcggtatgtcactggtacgtaaccagggctttaagaatttcgtgctgatgcagcaaaaaatggcggcgggtgaaaacccagcggcggagatgattaaaagtgtttcgctgatcattgctggtttgctgcttttattaccgggcttttttaccgacttcctcggtcttctacttttattgccgccggtgcaaaagcatctgacagtgaagttgatgccgcatttgcgcttttctcgcatgcctggcggcggttttagcgccgggaccggtggcggtaatacttttgatggtgagtaccagcgaaaggatgatgagcgcgaccgccttgatcataaagacgatcgccaggattaatgtcgaaacgccggattatgtggttatgccattttccggcgtttttcgttttggcagcaacagccataaccccgccagcatgatcagcgcatagagacttttccagccgaccattgccagtaacagaacgcataacagcccgccaaccaccgccagtagtcgataacgtccttgcaataatttacagcctgccagcatgcataacagataaatcataataaagatgccattggcataaataataagagcgtccagattgatctctaaagcatgaatcaccaaagtgctcaccacacagcagccgagcaccgcattgagggcattattcgggatatggcgagaagagaggcgtgccaggtagtggtcaggattatgttgcgcctgcgaccagaccaggcgggcgaagctctgtatataaatgttgagactggcaaagcaggccagatagccaatcacgcaggcaatccataacgctcctacaccgaacaactgcactacaatttttggaagcgatgctgccgccgccattttttcaccataggcgtcgaagtgtaagacgactaccgtacagccccagtagactaatcctgccagcagcagaccaatcatcaaagcacgaggaaaatcacgctctggatttttaaattccgaggcgagatgggcaaatgcctccagaccgacaaaacaccagaacatcactgataacgcagcaaataacccggtaagttcgatattaccaggtgccggaaaggggatattcgcaggtttgatatcgcccgcccaccagatagcgacaatcagcgcgacgataagtccggcaataacggtttgtagattagcactggaactggcaccgcgagtaccgatataccacaccagcgccagcgtaccgagttctgccaacaacagttgccagctatgccagccaaacatcgcctggccgaacccggcggcaatttgtagtgcggcaggcaaacccacgggaatgaccgataaaaacagccagccggtgactcgctcaagccgcgaaccaaacgccataccgacgaagtgcgcgacgccgcctgcgctgggatagtggcgacccagaatcgcaaacacaatcgcaatcgggaacactaagataatcaaaacgggccacgcccacaggctgttattgcccgctaccagcgcagctaacgcaggaacggcaaacacgccagtgcctaataatgacgtcgatagcaggccaatgccctgggccagccccagttcttgtttgagtccactcatgggttgatgtccgattgcgcccaaattttgggcaactgcgtagattttcgatggtagcacaatcagattcgcttatgacggcgatgaagaaattgcgatgaaatgtgaggtgaatcagggttttcacccgattttgtgctgatcagaattttttttctttttcccccttgaaggggcgaagcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcagccaggcgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagtagcccgtcgcagggaatgttgtccagttttgtcccgacggatagccagattatcggtcaggtttataagtgcccgaactgatgtgatccagaggctgggtgacaaacgtataattgcctgatgcgcttcgcttatcaggcctacataaggcattgcaactgattgaatgcttgagaatttgtaggccggataaggcgtttacgccgcatccggcatgaccaacgatcacgttatcagtcatttcaggctggatggctccagcctcgcattagcaaagatgagattatttcgcctgtggtgcagttttgctggtggattgaacacgtaagtgatgcagcgcgcgtaagcattgatcctgggttagcggttgggcgttattcgccgctacggtgcgaacatagacctgacatggcacacccgcgagttttttcagtcgtgggctgaaatcaagcattcggcgagtgatcgcttctatttctttacccggcgttgcttcacgcgttttcaccactgcgccgctaaattgttctttgccactttcatctttaaagcggtaaagcaccgccagataatggtcgaacaagttatgtttccattccggttgggaataggtgtcatattccagattgccattgtcctggcagtcaacgtcgtataacggcaggaaatctaacagtgaggtaatacgtaatgccagttcacgcatttccgcattattaattgcatgaatgattgctcgcgccagcatttcaatctgcaactcattgacgactaactcacatttgctaccgtcatgtagcgttaatacgaaggtaagattttcgccttgattatcggtaagttccagcgtgttaacccgacgattaatatcggcatttttaagctcatcaaccagaatttctgggatgttttctgccattttcttaatgactttatcgcgagcttgctcatactgaaggtgtgcagcagcatccagtttatgcttttgatgcagacgactttccagcgcaatcagcaggtcgcgcagttccatgacagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttaatttataagccagataaatgggcttggtagtaatagttgttaaaataacataaatagccgtactcactctatataaacagaaaagaaaggttaattattggtgttagctatataaaaagtaacaacagcaatgcatatgaataattaaaggttatgcaacgggcaaagattaaacttcccagtttaatgacaggttgctgtacttgcgtttgttgctcttgccggatgcagcgtaaacgccttatccggcctacagttcattgcaaatccattcaatttcaatgcacgatgtaggcctgataagcgtagcgaatcaggcaattttaatgtttaacttccctgtttaatcagttactgctggcgtagctggagatccagcggcgttttgctgggttcgccgccaatttctcgcgccagtttcggcaccagatatcccgacaccagtgtcagcaactcacgcataatctgccgtgcttcgtcatcactcaccataaaatgcgccgcgccctgtactttatcgagcacatgcaggtaatacggcattacgccggcatcgaacaacgcattactcaggtttgccagcgtttgtgcgttatcgttcacatcacgtaacagaacgctctggttcagcaaagtaacgcctacccggcgcaacttagccatcgcctgacggaatgtttcatctacctcattggcatggttgatgtgattcaccagcaagatttgcagcgtagaacgggcaaagcattcaaccagcgcctcggtgatacgtgccgggatcacaatcggcagacggctgtgaatccgcagacgttttatatgcgggatggcttccagttgtgtgagcaaccagtccagctcgtgatctttcgccatcagcggatcgccgccggagaaaatcatctcgtccagttccggatgcgcagcaacatactcaagtgcagtttgccagttacgcttgttgccctgattttcggcataggggaagtgacgacggaagcaatagcggcaatttaccgcgcagccgcctttgaccagcaaaagcgcccggttgtggtatttatgcaacaaaccaggcactacgctgtgctgttcttccagtgggtcggtggagaatccgggcgcgatgacaaactcatcttgcgaggtaagtacctgacgcaaaagaggatcgtccggattgcctttctccatgcgatcgataaatgagcggggcacacgcagggcaaaaagctttttggcgctgcgtccggctaacagtttttcctccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgatgcaaaagcaattggtgacaacgctaaatggctgctggatcaggcagagtgtatcgtaactctgtggaatggtcagccgatctccgttactccgccgaacttcgttgaactggaaatcgttgataccgatccgggcctgaaaggtgataccgcaggtactggtggcaaaccggctaccctgtctactggcgctgtggttaaagttccgctgtttgtacaaatcggcgaagtcatcaaagtggatacccgctctggtgaatacgtctctcgcgtgaagtaatgcggttgtggtgcggcctgcaggctgcaccatcacttattcaggtcagagatgatgaaacgccttatcgttcttgttttgcttgccagcacgctgctcacgggctgtaacaccgctcgcggtttcggcgaagacatcaaacatctcggcaactccatctctcgcgctgccagctaatttttcttctcttccgaaaaatcatcagattcccatcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataagcaataacggtacgacagctgtgtcgtgccgtttgttttttctgcgatagtcacaaaggtaatagttgaaattcccctgccacctggcaaaatatccgttcaaccatcagctttgcaggacgacctgcaaacgcctcttttcaccggggacggccccaattctccggagcctgatatgtcctggattatcttagttattgctggtctgctggaagtggtatgggccgttggcctgaaatatacccacggctttagtcgtttgacgccgagtgttattactgtgacggcgatgattgtcagtatggcgctacttgcctgggcgatgaaatcgttaccagtagggacggcttatgccgtgtggacgggtattggcgcagtcggcgcggccataaccggcattgtgctgctcggtgagtccgctaacccgatgcgcctggcgagtctggcgttaatcgtattggggattattggtctgaaactcagcactcactaactaccaggctgctgtacccaaataaatttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgcgccggtaaagtacgctttcccttcactctgctgccacattcctctgtcagggttatagcctttattaatgacattcaggccgccgtcatcacgcaggctgtatgttgcggtgactttttccagtccacgttcaaagcggtgatcaaaacgggcaatctcataccaggtaccgagataacgtttggcgtcgaaattatttactacggtcacgccacgcggcggcgtaggagaactgcaggcaacgaccagaaatgcagctgtcgctgcggcaacgagagggagcaggcgcataaatgtttccttactggtttttttctaagtgtagatgacagcaaggaaaagcggagaaaaggtccgaaaattcggacccgatggaattttactgtagagcgttaagaatctgccaggcggcgtcgactctcgctggattgggatagtttttgtttgccagcatcacgatacccagctctttttctggaataaacgcgacatagctaccaaatccgccggtcgcccctgttttatgtacccatgatgcgcgtactgcaggagttgggggcgtaatcgcttttacggggcgtgctgccagtgcaattttattgtcactgccgttaatgatgctgtcaggatttaccggccagtccagcatttcccagcccaggccctgatacatatcgccggtttgccagtagcgagattgtgccagttgtatcccttgttgaagcgttttctcattgatatcaaggggttttaaattgctttgcacccagcgggccatatcttcaatggtcgacttcacaccataagcttcagcatctaacgccccaggcgaaacatgcactgccttaccttcgcgatatccccaggcgtaattcttttcttctgcgggcggtacattaatccacgtatggttgagtttgagtggctggaagacacgagtttgcatcgcctgctcaaaactcaaaccagacggcttcacagccagtgcgccgaacaaaccgatactggagttggcatacagacgttgtgttcctggagcccatgcaggctgccagttttgatagaagcgcagcaagtcgcttgaggatttcacctcatccggcacctgcaatggcaggccgccagcagtgtaggttgcgagatgtaatagtgtgatcccattccactgtttagcggtaagttcaggccagtattttgttgtgggatcgcttaacttgatttcccctcgagcaatagcgtcgccaccaagcacgccagtaaatgttttgctgaccgaacctaactcaaacaacgtttgctgtgtgacgggctgctttttggcgatgtccgcatagccccaggtaaagtaataaggtttaccctgataaattaccgccaccgccatacccgggatcttttgttgctctataagcggggtaattgtgcgatgcacaatatcgttgatttgttgaggggcagcaaatgtggagcaagaggcggtaattaataaggcgcagagcgtcgttttgaacatagggtctggtttccatacaaaacggcccgccataggcgggccggatttacattggcgatgcgttagattgtaacgacaccaatcagcgtgacaactgtcaggatagcagccagaccgtagaaaacccatttgcccgcaggtacgtggattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagcgcatcacccggaaacaaccccagtggcagcagaatacccaccagcaggatcatcaccggcgcaatgatggcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggccgctttcggtgccagttcaaaccaggttttggtgtgcagcagagctgccgccagagtgatcaggttaatgatcacgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcagtagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacaaaccacagttgatgcaaccggagaactggtgatacttcgccatctgcgccggggtctggatgttagtaccctgatccgcggtgcgggagttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggaaccacaaatcgccatacggcaggaccagcggtagctcaggtccggtgccaggttgtctttgatgtagcccagcgcatccagtaatgaggtagttgcgtcataaggcacttcatagaatgcgctatgcggtgcggtatcgacttccgggttatagcgcaccacctcaattttcaggtttttcatctcagccattcgccttctccttcttattggctgcttccgccttatcggctgcatccgcttcgccaccgtaaacgcgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgcgcgccgcgggactctttacgtgccattgcggagtgcgccatacattcagcaacgttcagaccgtggcccagttcaatggtgtagagcaggtcggtgttgaacacgctggaagtgtcggtgatgcgcacgcgcttgaagcgttcctgcagctctgccagcttgtcgatggttttctgcatcagttccggcgtacggtagataccgcagccttcttccatagccaggcccatttcgtcgcggatcttcgcccagttttcgccgccatcctggttaaccagatctttcagacgttgttcaacgccagctgcctgcgcttcaattgccgcttcgttgccattaccggcagttgctgcacgctctgtcgcttgttcaccggccagacggccgaagaccaccagttccgccagggagttagaacccagacggtttgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaagtcgagataaaccacatcgccacgcggcgtggagatggtgttgcctttacgccattcgtgccagaaggcctgagagactttgtcgcgtggacccagttccatatatttgtttttcggctcgcccagcggagtttccgggcccatgccgtaatcttgcagataacggtagccatttttgttgaccagaataccgccttcaccgcggcaaccttcggtcatcaggataccggaacctggcagaccggttgggtgatactgaacgaattccatgtcacgcagcggaacgccgtggcttagcgccatacccataccgtcaccggtaacgatgccgccgttggtgttgtaacgataaacgcgacccgcaccgccagtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtgcgctcgattttcatgccgccgaagcgacgtacgttgacgctaccatccgggcgacggctccatgggcatccccacagttccagttgggtcatttcggttgggcagtggtggacgaaataatccacgacatcctgctcacacaaccagtcgccacccgctactgtatcgtgaaagtgatattcgaagctgtcatgatcctgcgcgacagcggcggagcccccttctgcagcaacggtatggctacgcatcgggtatacttttgagattagtgcgatttttgcattcggatttgcctgcgcggcagcaattgcagcacgtaatcccgcgccaccggcgcctacaatggcaagatcggcttgaaaggtttgcacgacattcctccagattgtttttatcccacagccacgtacttcagggtaagtacctgaaagttacggtctgcgaacgctattccactgctcctttataggtacaacagtatagtctgatggataagtctgaaatttgacgagatcgatttttttagtgcgcaagagggctaaattatcactgaagatgattaatttaattactaaaccatcagatcgtgctttttttagtcactgcccaccgctgtttgattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaaacgcctgctggttgccggttgtgggccggtattccagctgtgccgcagcttccgtaatgaagagatggggcgttatcacaaccctgagttcactatgctggagtggtatcgaccgcactatgatatgtaccggttgatgaacgaggtggacgatctcttacaacaggtgctggactgcccggcagcagaaagcctttcttatcaacaagctttcttgcgttatctggaaattgacccgctctctgccgacaaaacgcaactgcgggaagtcgcagcgaaactggatttgagcaatgttgctgataccgaagaagaccgcgacacgctgctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgttccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgttaaaggccacaatttaagactggatatttgatatcatccaggtatcaattctgtattggtttttacgctgcctgctcaatgttgcgcagtgcagttcagtgggcacgtgttatacacgcgctgaaatgaaggatggtttcatgcctcacacgataaaaaagatgagtctgataggactcatattgatgatctttacttccgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctatggtagcgacatgacccagcactggcgtattgccggactggagcctacgcaggtggttggtctgctggctgtggcatggatgattctggtcaccgtcgttgcttctaaggggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccgggttatcagtccggtctggcaatgctatcgtttgtggtatttgccatttttgcctatggcggaattgaagcggttggtggtctggtcgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagccttgggatgacgctgggtaatgcactgcatttgtcacctgaagcgtcattgtcgctgggcgtatggtttgcgcgtattactggactttcgatgttcctcgcctataccggtgcgttctttacgctttgctattcaccgttgaaagccatcatccaggggacgccgaaagcattgtggccggaaccgatgacgcgcctgaatgcgatggggatgccgtctatcgccatgtggatgcagtgcgggttggttactgtcttcatcctgctggtttcgtttggtggcggtaccgcatcggcgttctttaacaagctgacgctgatggcgaacgtgtctatgacgcttccttacctgttcctcgcgctggctttcccgttctttaaagcacgtcaggatctcgacagaccgtttgtgattttcaaaacgcatttgtcggcaatgattgcgacagtggttgtcgtactggtggtgacatttgcgaacgtcttcaccatcattcaacctgtggttgaagccggagactgggacagcacattgtggatgattggcggccctgtcttcttctcgctgttagcgatggcgatttaccagaactattgcagcagagtggcaaaaaatccgcagtgggcggtggaataacccgatgccctatcgtctacctgacgatagggcgtaaagacaggaaatgttatggatgacaccagccgggacccggcaataaccgaagatgaaatcagggcgctgcaattttctgccggggatgtagcggaaatagagcagacgattctctcttttgtcgatgcctgccacacccgtaaagtggcgatggtggtgggtagcaccattaacaccctcaaagatcgcgatggtaaacggtggggaaacctgccggatatttattgcgcttatcttatccgatgtctggtttttcgcggggaattagtgggatacggcgatttgtttcgtatgcgctatagcgaaattaagcgaccggttaccttatgagtgcgcgcatgtttgtcttatgctgcatctggtttattgtggcgttcctctggataaccatcacttccgcgctggacaaagagtggatgattgatggacgcgggattaacaacgtctgcgatgtgttgatgtatctcgaagaagacgatacccgtgatgttggtgtgataatgacgttaccgctctttttcccttttctctggttcgctttgtggcgaaaaaaacgcggctggtttatgtacgccaccgcgctggctattttcggctactggctgtggcagttttttctgcgctatcagttttgtttgtgagccggattggttcatccggcacacaaacttacaaacttcccgcctgacgacctttgcccgcagacgtcagcgttctccccgtttgtttaccgttgaggctttccagacgcatctggaagggcgggaatggcatatcgataccgtgggcatggaagccagccagaatcagctggtggatctcatggcgtagcggcatacggtgacccatctcagcggcgtaaatacgcagctcgaaaatctgaatcccctgttgcagatccaccaggaagacttccggtgccgggttgtcgatcaccagcgagcagcgacgcgctgcggtgagcaggatttccgtcacttcttcgctattggcatcggcaggggccggtatcgtcaacaccacgcgcgtgaccgagtcagagagcgaccagttgataaactgctcggtaataaacgccttgttcggcacgattatctctttacggtcccagtcgctgatggtggtggcgcgggtgttaattttcgtcacgctaccggtgagatcgcgaattgtcaccgtatcgccaatgcgaatcggtttttcgaacaggataatcagaccagagataaagttggcgaaaatttcctgcaaaccaaaaccgagaccaacaccgagcgcggcaaccagccactgcaatttcgaccactcaataccaatcattgagaagccgaccagcccgccaatcagcatcagcagatatttggtgatggtggtgatggcgtaacccgtacccggcgttaaatccaggtgctgcaaaatcgccagttccagcagcgcgggcaagttgcgcaccagctgcgtggtgatgataaacaccagaatggcaatcagcaccgcaccgagggtaattggctccagactttctacgccctgtaccgtggaggtgacatcccacagcgaaatattttcgaggaagccgaaagcggaatggatttctgaccacagcacaatgacagaaagcagggcgatcaacatcaaaattgagcgcaccagccgcaaggattgcgcactgatggcatcgagatcgacttcgctttcatcgacttcaattgctccttccgggctactgtgatgatgcgcttcctcttcgccacgcgcacgttgcgctaacatctctgcccggcgatgcttcgcccgatcaaacgccagcctgcggcgctggatcagcatccagcggcggataacgtgataaaccaccagtagcaggaaccagatggcaaccgaggtttcaagcctcgctaacagcgcctgtgccgttgccagataacccaccgccgacgccagaatggcaaccaacggcgcgccaatcatcatgttccacagcatatggttggtaatgttgtcgccgctgccctctttgttgagatacagcggaatcccggcctttttcaggctgagggtgaccaccgccagcgcaccgcaaatgaggataaagcaaagccgtcccagcgaaccggagaattcacggtcgtcgaggttatcgaacatcatcagcgccataatcagcggcacaataagcccgatgctcatcaggtagtagcgcatcccacgggaaacacgttcgcgcggccagccaaaatgagcgataaacaagccgttcgggcgggcaaaggtggcgcaaatcatcactacccacagcagcggcacggtggccgttacaccatcgccaatcgcgaccgccagcggataaggccacgcctcgcgcaagccgtaacccagcgtcatccacagcaccggtaacggtgacgcgacgagaatcgaccagaaaagagtgcgcaacgtcagccagaagtgatcctgagtcactttgccaactttcgccgccgaacgttcaagaaaacgggtgaaatagcggcgcgagtaaatactgcaaccgaccagaatcaacgcgccaaacagcggcaaaattgtctctttgctggtcagcatcatcacactggctttgcccaactgactgaaggtgtccagcgaaatgagacgacgcagatcctgggcgatttccagcggccaggcgatggtcatcgggcgcacgtcagaggtccagaacagatagcggtgcgttgcttcgttcacctctttcagcgcatcctccagttgcccgttggagactttcagcttggtcagttccaatagtagcgtgtcgccaccctgcaacaatgagttcagcaactcacgctgagtgcgcagttgtgcttccagaatacggttttgctcggcagtcagcggctgaccgtcggcctgatgaatttgccgtagcagcggctgtttattaagcagatcctcataacgtaaccgttgcacacgcaactgcgccatttcggtatcaagctgttgtggtttcggcatttccggcagccgtgccacctgcgcccgcagcgcttcgccgagcagattggacgatcccagccattgcgactgttcacgcagcgtattcaacgcctgccggacctgtaacgtctggctggcagcctgacgctgttgcgaggcaacgagatccatccgctgcgcctgttgattcaaagccgccgatagttcgcggttaattttgaattgcgcgacgatatctttcggcaaatcggcgctgttttctgccagcaattcggtactttccagcgcccgctccgcctcaagctgacgttggctgtttaattgattacgcaaggcctgcaaatacgcatccagttgctggctctctttttccgccagctctgagcgtaagcgcgctaattcctggcggttattggcagacagctgcgccagctccagttcatcaacgagcgccttaagacgtgcagagtcagactgcaacgcgaaattttgtgcctgattgagcggagtattgccggtaagcgttcccaggcggcgctcgatctcatttaactgacggcgggcgtcggtttgctgttgcggcagttgattcagcgaatcggcaatctcgcgggcgcgctcctgctcttgctgggcctgacggcttttatccagcaactggctgctgacctggagaatttcctgattcagcgcgtcggtagacattcccggcgacacgctgcgcggctcgtcacgcatgttgtttaattgtgcgcgcagagtagcggagagtttcggataattatcgataacttgctgatattgtttgatgcgctcaagggaaccttttcgttcctcaagcgcatttaaggcagactggagcgcctctacgacttccggctgtgcgggtttcgccgcttttgcctgctccagttcctgagtgatttgtttgctatcgggggccgtcgcggcgtacgccccccaactgaggcaccaggccatcagaaaagtgataatcaggcgcacgtcagcgtttcctttgatggattagacctggtcttttttgtcgtcaaccaatgggctggcgtcgtgttctgcttcgatctcttcagcaggaagcggggcaggttcagcgtctggcgtaacaaaggtttcggtagatactgccagcggctggccaattttcgtgacagacaggctttccagttgctcaaccagattcactttacccggtgcaaacaggttgataacggtggaaccgagtttaaagcgacccatttcctggcctttcagcagtgccacagaaccgtcgttttccccggcaggccaggtccagcgcttgatgataccttcgcgcggcggcgtaatggtgcccgcccagaccgtctcaatgctgccaacaatcgtcgctccgaccagaatctgcgccattgggccaaattcggtatcgaaaaggcaaatcacgcgttcgttacgggcaaacagattcggcacgttctgagccgtgagatggttaacggagaagagatcgcccggcacgtagatcatctcacgcagaataccgttgcacggcatgtgtacgcggtggtagtcacgcggggagaggtaagtggtcacaaacgtaccgttgcggaacaggtccgccatcagatagttgcctgccagcagggcttcgaggctgtagttgtggcctttggcttgcaggattttatcttcttcgattttacccaactggctgataacgccatcggcaggcatgaccagtacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggcctacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgattttcccttcctcaaccgcttcccggatagcgcagcccggatcggtatcgtgtttgcaatcgcgatatttacacagacctaaatagtcatggaattcgacaaagccctgagtgatttgttccggctccaggtgccagaggccgaactcacgcactcctggggagtcaatcacatcaccgccgtgcgggaagtgatacagccgagcggcggtcgtggtgtgctgaccgagccccgagttgtcagagatatcgttggtcaggatctctttttgcagccccagcaacgcattcagcaggctggatttgccgacgccagactgcccggcaaaaatgctgatgcgcccggtcaacgcctcttccagcggttttagcccatcctgagtatggctggaaaccatcaatacgcgataaccgatattgcggtagatatccatctgctcgttgacgaacgccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcggcaataggttttacgccgtcgtagaaatccggacgcgtcaacaccgaggtacgctcatgcaccgcttccacgatccctttgacatttacgccttccgccgccggtttacccggacgccagactacgcggtcgccggttaccagcgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacaccagtctgatgaacagctggcgctgatggatgactggaacgtgcgcacccataccgccagcgggctggtagagcgcgtgaaagcgagcacgatgggcgatcgggaagctgaactggcaacgctcgaatttttaaaacagtgggtgcctgcgggaaaatcgccgatttgcggtaacagcatcggtcaggaccgtcgtttcctgtttaaatacatgccggagctggaagcctacttccactaccgttatctcgatgtcagcaccctgaaagagctggcgcgccgctggaagccggaaattctggatggttttaccaagcaggggacgcatcaggcgatggatgatatccgtgaatcggtggcggagctggcttactaccgcgagcattttatcaagctgtaaaatttttcctggtcacgtaagcgccggaatccacttgcggcggcgtgattttgacgctaaattgaacgtcttgctgataatttcagcacttgagataaaaacgcaaaaaaaacttttttggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgcaaagcacagaccacccaagcgggaatagctcagttggtagagcacgaccttgccaaggtcggggtcgcgagttcgagtctcgtttcccgctccaaaatttgaaagtgctgtaaggcacagaccacccaagcgggaatagctcagttggtagagcacgaccttgccaaggtcggggtcgcgagttcgagtctcgtttcccgctccaaattcttctctcaataaaatatccacagcgacgcgatgcgttattgctggtttttgttgtctctgacaaactcttgtaaacagagttatccacagcctcaggctgtaatcttaatttcaaagaaacttcgcacggtgaatagtatttttttaacctattgatagataagttaaaaattaagattccgttttgtcgagtcgatcacttgacgattttattcgtcttgaattgcaatgcgtttttatttttattcacaagctgtggatgaatcaggcgtcacgcggtaaccctttttcaatcacccgaaccagacgctgttttttcggcaattgcacttcgactatgcacgcatttcgtctctctatttgctgcgcaatcgcccacgctatgtgctcatcgagaagtgggtgctcacctttacgactttccagcgctgtcaaaatcgtttcatcccaaggggcattgcctaatgctacggcgatattacgcagccaacgcaggtgaccaatacgacgaatcgccgatccttccgtgacttttaaaaacttctcttcgctccaggcgaataactcaatgagttccggtgcgtgtagcggcttacgcgggctgaaatcctcttctgtggtgagttgtgaatagcgattccacgggcagataagctggcagtcatcgcaaccgtaaatacggtttcccattaacggtcgcaactcttccgggatcgccccttcaagttcgatggtgagataagagatacagcggcgagcatcgacggtatatggctcgacgatggcaccggtcgggcaaatcgtcatacaggccacgcatttgccgcatccttcctcgactggttgatccacgggcagcggaatatcgaccagcaattcgcctaaaaagaagaacgaaccggcctcgcgattgaggataagtgagtgcttacctgtccagccgagcccagctttttcagctaacgggcgctcgagaataggcgcagaatcgacaaacggtctaaaattcagcgaaacacaatgttgctgaatcatctcgcccagctttttgagtcggttgcgcagaagtttgtgatagtcacggcccagcgcataacggctaacatagccgagtttggggtttttcagcgtgctggcaaatgcggcgttagcaggaaggtaattcatccgcacgctgatcacgcgcagcgtaccgggcaataactcatgagggcgagcgcgcagcataccgtgacgtgccatccagtccatttcgccgtggtattgtttgtccagccatgcttgcagtttgggctcggactcgctgagatcggtatcggtaatacctacctgctgaaagcccagttccagcccccactgtttaattttttgcgctaactgattgagatcgaggggctctgacatgacggaccatacaatgaagaaaaaccccgtaagtataccacacaccgtctggtacgccgacgatatccgccgcggagaacgcgaggcggcagatgtgctggggctcacactctatgagctgatgcttcgcgctggcgaggccgcattccaggtgtgtcgttcggcgtatcctgacgcccgccactggctggtgctgtgcggtcatggtaataacggcggcgatggctacgtggtcgcgcgactggccaaagcggtcggcattgaggtcacgttgttggcccaggagagcgacaaaccgttgccggaagaggccgcgctggcacgcgaagcatggttaaacgcgggtggcgagatccatgcttcgaatattgtctggcccgaatcggtagatctgattgttgatgcgctgctcggtaccggtttgcggcaagcgccccgcgaatccattagccagttaatcgaccacgctaattcccatcctgcgccgattgtggcggttgatatcccttccggcctgctggctgaaactggcgctacgccaggcgcggtgatcaacgccgatcacaccatcacttttattgcgctgaaaccaggcttgctcactggaaaagcgcgggatgttaccggacaactgcattttgactcactggggctggatagttggctggcaggtcaggagacgaaaattcagcggttttcagcagaacaactttctcactggctaaaaccgcgtcgcccgacttcgcataaaggcgatcacgggcggctggtaattatcggtggcgatcacggcacggcgggggctattcgtatgacgggggaagcggcgctgcgtgctggtgctggtttagtccgagtactgacccgcagtgaaaacattgcgccgctgctgactgcacgaccggaattgatggtgcatgaactgacgatggactctcttaccgaaagcctggaatgggccgatgtggtggtgattggtcccggtctgggccagcaagagtgggggaaaaaagcactgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcgccaaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaactgtcgccgtatgatgcagcctgtgcaggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggcgcaggtaaaaccacctttagccggggctttttacaggctctgggtcatcagggtaatgtcaaaagccccacttatacgctggtcgaaccctatacgctcgacaacttaatggtctatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgctgctgctgctgtgcacgccggtgggtgccgcgacgctctctgatattcaggtttctaacggtaatcaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaacggtaaaaccgaagcggtgaagcggcagaatggcagcaattacactgtcgtctttacgattaacgccgatgtgccgccaccgcctcctccgccgcccgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacactggcgataaaattatcatcgctattgatgccggacacggcggtcaggaccctggcgctatcggccccggtggtacgcgggagaaaaatgtcaccatcgccatcgcgcgtaaattgcgtactttgctcaatgacgatccgatgtttaaaggcgttttaacccgtgacggggattactttatctcggtgatggggcgcagtgatgtggcacgtaagcaaaacgccaatttcctcgtgtcgattcacgctgatgccgcaccgaaccgcagtgcgactggcgcttccgtatgggtgctctctaaccgtcgcgccaacagtgaaatggccagctggctggagcagcacgagaaacagtcggagctgctgggtggggcgggtgatgtgctggcgaacagtcagtctgacccctatttaagccaggcggtgctggatttacagttcggtcattcccagcgggtagggtatgatgtagcgaccagtatgatcagtcagttgcaacgcattggcgaaatacataaacgtcgaccagaacacgccagccttggcgttctgcgctcgccggatatcccatcagtactggtcgaaaccggttttatcagcaacaacagcgaagaacgtttgctggcgagcgacgattaccaacaacagctggcagaagccatttacaaaggcctgcgcaattacttccttgcgcatccgatgcaatctgcgccgcagggtgcaacggcacaaactgccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacggcgttagccattgagctgcgtaaaattttaccagtagagttgataagcgttgattctgcccttatttacaaagggatggatatcgggacggcgaagccgaacgctgaagagttactcgccgcgccgcaccgattgctggatattcgcgatccgtcgcaggcttactcggctgctgattttcgccgcgatgcgctggcggaaatggccgatatcaccgcggcggggcggatcccactgttagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgcattgagcagcgttttcatcagatgttggcttcaggttttgaagcagaagtccgggcgctttttgcccgaggagatttgcatacggacttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaagggcaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactaccatcatggtagcagcgcgcagaatacttccgcgcaacaggacagcgaagaaaccgaataaggtttcgggctgtttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagctgtcaaagcgacgggtgcttcggtcgttctttttgaccatgccctgagcccggcgcaagagcgtaacctggagcgtttgtgcgagtgtcgtgttatcgaccgcaccggccttattttagatattttcgcccaacgtgcgcgtacccatgagggtaagttgcaggttgagctggcgcagctgcgccatctggctacgcgcctggtgcgtggctggacccaccttgaaagacagaaaggcgggataggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctacccttttcaatcgcatcaccgaagcgcgggtctacgcggcagaccagttgtttgccaccctcgacccgacgttgcggcgtattgacgttgcagatgtcggtgaaaccgtacttgcagataccgtagggtttattcgccacctgccgcacgatctggtggcggcatttaaagccacgttacaagagacgcggcaagccacattactgctgcacgtcattgatgcggcggatgtgcgtgtacaagaaaacatcgaagcggtgaatacggttcttgaagagatcgacgctcacgagatcccaaccctgctggtgatgaacaagatcgatatgctggaagatttcgaaccgcgtattgatcgggacgaagagaacaaaccgaaccgtgtctggctttccgcacagaccggagcggggataccacagctttttcaggctttgacggagcggctttccggcgaggtggcgcagcatacattgcgtctgccaccgcaggaagggcgtctgagaagtcgtttttatcagcttcaggcaatagaaaaagagtggatggaggaggacggcagcgtaagtctgcaagttcgtatgccgatcgttgactggcgtcgcctctgtaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgtgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtgaacgtggaagccgtgcgtgaactggccgcttctggtgtgatgctgacgtcggacgagaacgtagtgcgcgttgagatgaacgtgcagtaccgcgtcaccaatccggaaaaatatctgtatagcgtgaccagcccggatgacagcctgcgtcaggctaccgacagcgccctgcgtggagttatcggtaaatacaccatggaccgcattctgacggaaggtcgtaccgtgattcgtagcgatactcagcgcgaactggaagagacgattcgtccgtatgacatgggtatcacgctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggtaacacccgcaaagtgctggttaacgataaaggtggcaacctgatggttctgccgttagaccagatgctgaaaggtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactacctggcaacgggtggtggcgacatttcgcaagcggaagtgctgttgaaacgtaagttctctgaccgtctgcgttctgaaattggtcgcctggacgtgaaagatatcgtcaccgattcccgtggtcgtctgaccctcgaagtacgtgacgcgctgaactccggttctgcgggtacagaagatgaagttactaccccggcggcagataacgccattgccgaagcggcagagcgcgtaacggctgagacgaagggcaaagttccggtcatcaacccgaacagtatggcggcgctgggtattgaagttgtcgatgtgcgtatcaagcagatcaacctgccgaccgaagtgtctgaagcgatctacaaccgtatgcgcgccgagcgtgaagcggtagcgcgtcgtcaccgttcacaaggtcaggaagaagcggaaaaactgcgcgcgactgccgactatgaagtgaccagaacgctggcagaagctgagcgtcagggccgcatcatgcgtggtgaaggcgatgccgaagcagccaaactgtttgctgatgcattcagtaaagatccggacttctacgcattcatccgtagcctgcgtgcttatgagaacagcttctctggcaatcaggacgtgatggtcatgagcccggatagcgatttcttccgctacatgaagacgccgacttccgcaacgcgttaatataacgactgcggtacaggtcaataaagccaccgcatcctcagggatgtcggtggttttctttttctataaggataatgaatgaattcgacaatctggctggcgcttgccctggttttggtactggaaggtttagggccgatgctttacccgaaggcatggaagaagatgatctctgcgatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactatatcaagcgtattgaagagctgactggtgtgccgatcgatatcatctctaccggtccggatcgtactgaaaccatgattctgcgcgacccgttcgacgcgtaattctggtacgcctggcagatattttgcctgccgggcgaacagtgtgatacattgctgtgtcgggtaagccattacgctatccgacacagtgttaaatcctcgcttttttccttccccgaactgaaataaattagcgacacagcttgtggctggtttatcatcaatataaatgtattttttcccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcctgggtaaaccggcgagtgcgatacgtattggtgatgtggtgcgcgagctggagcccttatcgctggtgaattgcagcagtgagttttgccacattacacctgcctgtaggttgaaacaggcactttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgtcgtcagtgctatgcgctgccggaacgcctcgacctggtgaaaggtaccgttattggccaccgtgatggctacggctttctgcgggttgaagggcgtaaagatgatttgtatctctccagcgagcagatgaaaacctgcattcatggcgatcaggtgctggctcagccgctgggtgctgaccgtaaaggtcgtcgtgaagcgcgtattgtccgcgtactggtgccaaaaaccagccagattgttggtcgctactttaccgaagcgggcgtcggctttgtggttcctgacgacagccgtctgagcttcgatatcttaatcccgcccgatcagatcatgggcgcgcggatgggctttgtggtcgtagtcgaactgactcagcgtccgactcgccgcaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagcgggccgtgttgatctgcgcgatttaccgctggtcaccattgatggcgaagacgcccgtgactttgacgatgcagtttactgcgagaaaaaacgcggcggcggctggcgtttatgggtcgcgattgccgacgtcagctactatgtgcgtccgtcaacgccgctggacagagaagcgcgtaaccgtggcacgtcggtgtacttcccttcgcaggttatcccgatgctgccggaagtgctctctaacggcctgtgttcgctcaacccgcaggtagaccgcctgtgtatggtgtgcgagatgacggtttcgtcgaaaggccgcctgacgggctacaaattctacgaagcggtgatgagctctcacgcgcgtctgacctacaccaaagtctggcatattctgcagggcgatcaggatctgcgcgagcagtacgccccgctggttaagcatctcgaagagttgcataacctctataaagtgctggataaagcccgtgaagaacgcggtgggatctcatttgagagcgaagaagcgaagttcattttcaacgctgaacgccgtattgaacgtatcgaacagacccagcgtaacgacgcgcacaaattaattgaagagtgcatgattctggcgaatatctcggcggcgcgtttcgttgagaaagcgaaagaaccggcactgttccgtattcacgacaagccgagcaccgaagcgattacctctttccgttcagtgctggcggagctggggctggaactgccgggcggtaacaagccggaaccgcgtgactacgcggagctgctggagtcggttgccgatcgtcctgatgcagaaatgctgcaaaccatgctgctgcgctcgatgaaacaggcgatttacgatccagaaaaccgtggtcactttggcctggcattgcagtcctatgcgcactttacttcgccgattcgtcgttatccagacctgacgctgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgacgaagcaacgcgcgatgtggctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgaccaggtagggcaacgcctgatgggggaatccagcggccagacttatcgcctgggcgatcgcgtggaagttcgcgtcgaagcggttaatatggacgagcgcaaaatcgactttagcctgatctccagcgaacgcgcaccgcgcaacgtcggtaaaacggcgcgcgagaaagcgaaaaaaggcgatgcaggtaaaaaaggcggcaagcgtcgtcaggtcggtaaaaaggtaaactttgagccagacagcgccttccgcggtgagaaaaaaacgaagccgaaagcggcgaagaaagacgcgagaaaagcgaaaaagccatcggcgaaaacgcagaaaatagctgcagcgaccaaagcgaagcgtgcggcgaagaaaaaagtggcagagtgatcaataccctctttaaaagaagagggttagattgctgacaaaatgcgctttgttcatgccggatgcggcgtgaacgccttatccggcctacataatcacgcaaattcaatatattgcagagatcatgtaggccggataaacgtagtgcatcaggcaaaacgtaaacaacgagtacattaatgagcgaaatgatttacggcatccacgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgacgagaaaagcgacggtgccgtgcatcagggcattatcgcccgcgtgaagccaggacgtcagtatcaggaaaacgatctgccggatctgatcgcttcgctcgatcaaccgttcctgctgatcctcgacggcgtaaccgatccgcacaacctcggcgcgtgcctgcgtagtgcggacgccgcaggcgttcatgcggtgattgtgccgaaagatcgctccgcacagctcaacgctacggcgaaaaaagtagcctgcggcgcggcagaaagcgttccgctgattcgggtgactaaccttgcgcgcaccatgcgtatgttgcaggaagagaatatctggatcgtcggtacggcaggcgaggcggatcatacactctatcagagcaaaatgaccggacgcctggcgctggtgatgggtgcggaaggtgaaggtatgcgtcgcctgactcgtgaacattgcgatgagttgatcagcatcccgatggctggaagcgtttcttccctgaacgtttcggttgcgaccggaatttgcttatttgaagcggtgcgccagcgcagctaatttctcagaattatgaaaagccatccagatttggatggtttttttttgtctatagctggtaagataattacgtattgcaaatattcattttattaatatttaaacttaatctatatggaataatatatgacatggaatccgttggcgctagcgacggcgctgcaaactgtacctgaacaaaatattgatgtaacaaatagcgagaacgcattaattattaaaatgaatgattatggcgatttgcaaatcaatattctttttacttcccgccaaatgattatcgaaacctttatttgtccggtgagtagtatcagcaatccagatgaatttaataccttcttattaagaaatcagaagatgatgccgttgtcatcggtagggatctccagcgtacaacaggaagagtattacattgttttcggggcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagaatccattgaagaaacccagggcgtgcgcatgctggaacagcatattcgtgacgctaaagctgaactcgataaagccggaaaatctcgcgttgatctgctggcgcgggtgaaattaagtcacgataagctgaaagatttacgtgagcgcaaagccagtctggaagcccgtgcgctggaagcgttaagcaagaacgttaatccgtcgttgattaacgaagttgctgaagaaatcgcgcgccttgagaatctcattaccgctgaagagcaagtgttgtcgaatctggaagtctcccgtgatggcgtggaaaaagcagttacagcgacagcgcagcgtatcgctcagtttgagcagcaaatggaagtcgttaaagccactgaagccatgcagcgtgcacaacaggctgtaacaacctctaccgttggcgcatcttccagcgtttcgacagcggcagaatccttaaaacgcctgcaaacgcgtcaggccgaacgtcaggctcgcctggatgctgccgcacagttggagaaagtcgcagacggtcgcgaccttgacgaaaagctggcggaagccggaattggcggtagcaataaaagtagcgcccaggatgtattagcaagactgcaacgccaacagggcgagtaatttttttgccagcctcgctaaaaggctggcaactattttaaggataaaatatgtctggttttttccagcgtctgtttggcaaggataataagccagctatcgctcgtggtccgctgggacttcatctcaatagtggctttacgctcgacacgttagcgtttcgtttgctggaagatgaattgctgattgcgctgccgggtgaggaatttacggtagccgccgtcagccacatcgatctgggcggcggtagtcagattttccgctactacacttcaggcgatgagtttctgcaaatcaataccaccggcggcgaagatattgatgacattgatgatatcaagctctttgtctatgaagagagctacggtatcagtaaagagagtcactggcgcgaggcgatcaacgccaaagcgatgggagcaatgaccttaaactggcaggaaaaacgctggcagcgattttttaacagcgaagaaccgggaaatatcgaacccgtctacatgctggaaaaagtagaaaatcaaaaccatgccaaatgggaggtccataattttaccatgggctaccaacggcaagtaaccgaagatacttacgaatatttgctgctaaatggtgaggaatcttttaacgatctcggcgagccagagtggttattttcgcgcgcgttgggtgtcgatatcccgctgacatcacttcatattattggttaattacaaggacgtttacaatgcatatactggattcacttcttgcctttagcgcctatttttttattggcgtggctatggtgattatttttctgtttatctattctaaaattacaccgcacaacgaatggcagttaatcaaaaacaataataccgcggcgtcactggcgttcagcggtacattgttgggttacgttatccccttatccagtgcggcaatcaatgcggtgagtattccagactatttcgcctggggcgggattgcactggtgattcagttactcgtttttgctggtgtcagactttatatgcccgcattaagcgaaaaaattattaatcacaataccgcagcaggaatgtttatgggaaccgccgcgctggctggcggtatttttaacgcagcttgtatgacatggtaatggacgatcatggccagaaaacgcaaatcaagaaataacagtaaaattggtcacggagcgattagtcgcattggtagaccgaataatccttttgaaccgtgccgcaatcgctacgcacaaaaatacttaacgttggcgctaatgggcggtgccgcttttttcgtattgaaaggttgtagcgatagtagcgatgtcgataacgacggcgacggaacgttttacgcgacagtgcaggattgtattgatgacggtaataatgccgacatttgcgcgcgtggctggaacaacgccaaaacggcattttatgccgatgttccgaagaatatgactcagcagaactgtcagtctaagtacgaaaattgctactacgacaatgttgaacagagttggatcccggtcgtttctggatttttgttaagccgggttattcgtaaagatcgcgatgagccgtttgtttataacagcggcggttcctcttttgcttcgcgcccagtctggcgcagcacttctggtgattactcctggcgctccggttctggcaaaaaagagtcttactcttcgggcggctttaccaccaaaaaagcgtctaccgtttctcgcggcggctatggtcgttcttccagcgcccgtgggcattggggaggctaatcatgctgagacacaacgttcctgtgcgacgggatctggaccagatcgccgctgacaacggtttcgactttcatatcatcgacaatgaaatctattgggatgagagtcgggcttaccgttttactctgcgccagattgaagagcagatcgaaaaaccgactgcggaactgcatcagatgtgccttgaggtggtggatcgcgcggtaaaagatgaagagatcctgacgcaactggcgatcccgccgttgtactgggatgtgatcgctgaaagctggcgcgcccgcgatccttcgctgtatggacggatggattttgcctggtgtggcaatgcgccggtgaagctgctggagtacaacgccgatacgccaacttcattgtacgagtcggcttatttccagtggctgtggctggaggatgcccggcgcagcggcattattccgcgtgatgccgatcagtacaatgctattcaggaacgcctgatttcacgctttagcgagctttacagtcgggaaccgttttatttttgctgctgtcaggacaccgatgaagacaggagtaccgtgctgtacttgcaggactgcgcccagcaggcagggcaggagtcgcggtttatctacattgaagatctcggtttgggcgtcggcggcgtactgaccgatcttgatgataatgtcatccagcgtgcatttaagctgtatccgctggagtggatgatgcgtgacgataacggtccgctgctgcgcaagcgtcgcgagcaatgggtggagccgttatggaaaagtatcttgagtaataaagggctaatgccgctgctttggcgcttcttccctggtcatcctaatcttcttgcgtcctggttcgatggcgagaaaccgcagattgccgctggcgaaagctatgtgcgtaaaccaatctattcgcgcgaaggcggcaacgtcaccatttttgacggcaagaataacgttgttgaccacgctgatggtgattacgccgatgaaccgatgatctaccaggcgtttcaacctctgccgcggtttggcgatagctacacactcatcggtagctggattgtcgatgatgaagcgtgcggaatggggatccgtgaagataacacactgatcaccaaagacacctcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacctataccattaaataacagcaacttatacctgtctgatggcgcgctctgcgaagcggtaacgcgtgaaggtgctggctgggatagcgattttctagccagtattggtcagcagttaggaacggctgaatcccttgaactggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggcagggtcgttatgtccgataaccatgacctttgccgccacgccattgttgttacagatgttacccgcgccgtttcaggactggaccacgccgctattgagcgatcgctacgattctcacttattgccaggtgggcaaaaacgcggtttgttgattggcatgggaatgacggaaaagcagggcggttccgatgttatgagcaacaccacccgtgcagagcgtctggaagatggctcttatcggctggtggggcataaatggtttttctcggttccgcaaagcgatgcgcatctggtgctggcgcagaccgcgggtggtctgtcctgcttttttgtgccgcgctttttgcctgacgggcaacgcaacgcgattcgcctcgagcggctgaaagataagctgggtaatcgctctaacgccagttgcgaagtggagtttcaggatgccattggttggttgttggggctggaaggggaaggaattcgtctgatcctgaaaatgggtgggatgacgcgttttgattgcgccctgggtagccatgccatgatgcgccgtgcattttcgctggcgatttatcatgcacatcaacgccatgtttttggtaatccattgatccaacagccccttatgcgtcatgtcttaagtcgcatggcacttcagcttgaagggcaaacggcgttgctgtttcgtcttgcgcgagcgtgggaccggcgtgccgatgccaaagaagccctgtgggcgcgtttatttacgcctgcggcaaaatttgtgatctgcaaaagaggtatgccgtttgtggccgaagcgatggaggtgctgggcggcattggttattgcgaggagagtgagctgccgcggctttaccgggagatgccggtaaacagtatttgggaaggttccggcaatattatgtgcctggatgtgttgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaactggggcgagagattactcatcagctattcctgctgggctgcggtgcgcaaatgttgaaatatgcttctccgccaatggcgcaggcgtggtgtcaggtgatgttagatacgcgcggcggcgtacggttgtcagagcagatccagaatgatttattgctgcgggcgacggggggagtgtgtgtgtaagcgtatacgactgatgcgacgctggtttcgattaactaaatgaaatatgtgaaaattgtaggccggacaaggcgctcgcgccgcatccggcattgttcatttgctgtagatgacactcatgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtcactaattgcagcgagggtgaggcaagtaattgtttcatcgtcagctccatttttcgtttccccacatgttgcagggcattccatcgcggtaataaacgcccaggcttccagccggtaatttattgtgcacaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagctttcgctttgatttctgctaatgcgtcatccggagaaccccgaaccatcgtgcttacgctacctattcgctgtaacccttgcgtctggtcgcggcgaatctcttgcggatggtccgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgcgtaattttttatcacggctttacttcatccagtctggtgtatagctattttgccgttgcgctggcgcaggctggtttgcgggtgatcatgccggatgcgcccgatcacggtagccgttttagtggtgacgcagcgcggcggttaaatcaattctggcaaatcttgctacaaagtatgcaggaattcactactttacgtgcggcaatagccgaagaaaactggctgcttgatgaccgtctggcagtcggtggcgcgtcgatgggcgcgatgacggcactggggattaccgctcgccaccccacggtgagatgtaccgccagcatgatgggatcgggctattttacatcactcgcccgttcactgtttccaccgctgatacctgaaacggcagcacagcagaatgaattcaataacattgtcgcgccactggcagagtgggaagcgacaaaccacctggaacaacttagtgacagacctctactgctgtggcatggcctcgacgatgacgttgtgcctgccgacgaatcactacgtttgcagcaggccttaagcgagacgggacgggataaactgctaacctgttcatggcagccaggcgtgcgtcaccgcattacgcctgaggcgttagatgctgccgtgacatttttccgccagcatctttaaacacgcagaatgctgaccccttgcgcttccagttgttgcaggatttccgggttagcatttttgccggtgataagcatatcgatttgatcggcacggctaaaaagcattcccgcgcgttcgccaatcttactgctatcaaccagtaccaccagtttccctaccacgctcagcatcttctgctctgccattgctgtcagcatatcggttttatacaacccttctgcggtcagcccttttccgctggtaaacatccagtgcccggcatagagactgttttcgctgccctgcgggcttaaagtgatggactgacttttgttgtactgtccgcccataatgatcacgctgtcatgttcttgatcgatcaggtaatttgccagcggtagataattagtgatgatttgcactggcttgccacacatttcccgcccaagcagaaacgcggtggagccgcagttgatgactacgctttcgcccggattaaccagctgcgaggccgctttagcgatacgtactttttcatcgtgattctgcgcctgatgcagattcatcggcgtccagcgcgggcgctgttgggtaatagcttctgcgccattgcgcacttttttcagtttgccgctttcgtcaagtttattgatatcgcgtcgcgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactacgccggatagcgcgaacttctccacgctacccggtataaacgacagattacaggaatgacttgaacggcagatccggttcaatagtgaagcaatcatcgaaaccgcgcggatagtggtactcgaagttgtctttatccagcggccaggtaaatttgccacccacctgccagataaacggcttgaagccatacttcaggcgatcttttttcatctcccacagcacgcggatctcttgcggatcggcctggaagtttgaccagatatcgtggtggaacgggatcactactttcgcattcagcgcttcacccatacgcagcatatcggcgctggtcattttgtcggtgataccgcgcgggttttcgccgtacgatcctaacgccacgtcgatctgatgttcgttaccgtgcttcgcataatagttagagtagtgggagtcgccgctgtgatacagggagccgccaggcgttttgaacaggtagttcaccgcgcgatcgtccatgccatctggcagtacgccagccgctttttgatcggcaggcagggtgatcagtgcagtacggtcgaaagcatcaagcgcatgaatttcaatgtctttcacttttactacatcgcccggtttgaccacgatgcaacgctctttcggtacgccccagccaatccacaaatccacacaggttttcggtccgataaacggtacgtcatctgcacaattctgcatcacggcagcagcgacgttaacgtcgatatgatcgttgtgatcgtgagtcgccagtaccgcgtcgatctggcgaatcgcaaacggatcaagaacaaacggggtggtacgcaggtttggctgcagttttttcacgccagccatgcgctgcatctggtgaccctgtttcattaacgggttaccgtgactttgtttgccagtgccgcaccagaaatcaacgcaaacgttggtgccaccttccgatttcaaccagatcccggtgcagccaagccaccacatcgcaaatgtgccaggagcgacctgttcttgttcaatttcttcattcaaccagctaccccactccgggaaagtgctcaggatccaggattcacgggtgatacttttcactttactcatcgccatttaccttcatgatagttcaattcgaatcaatatgtgattggttttgattaatcctgacactattttttcaggaaggcaatgaccattttttgactttttgccagggaagttgttgttgattttgagtatggaaagatttaatggaatgtgtaattcaattaactaaatgaatttaaatggataattgtttcgttgtgtgaatcccactctatccatgtggaattatttgcgggtcgcgtcacatttaatcataaataatcttgttgtgattacttttgaaaattagagtgagtgcacaacattccgggtgtgtggaatacccggttacctcttcttcaggagatcgttatggagatcctctacaacatctttaccgtgttttttaaccaggtcatgaccaatgccccgttgttgctgggtattgtgacctgtctgggctacatcctactgcgcaaaagtgtcagcgttattattaaaggcacgattaaaaccataattggtttcatgttgttgcaggcagggtccggcatcctcaccagcaccttcaaaccggtggtggcgaaaatgtccgaagtctacggcattaacggcgcaatttccgatacctacgcttcaatgatggcaaccatcgaccgcatgggcgatgcctatagctgggtgggttacgccgtattgttagcgctggcgctgaacatctgttacgtgctgttgcgtcgcattaccggcattcgcacaatcatgttgaccggccacatcatgttccagcaggccgggttgattgccgttacgctgtttatcttcggctactccatgtggaccaccattatctgtaccgcgattctggtttcgctctactggggcatcacttccaacatgatgtacaagccgactcaggaagtgacggatggctgtggtttctccatcggtcaccagcagcagtttgcatcatggattgcctataaagtcgcgccgttcctcggcaaaaaagaggagagcgttgaagacctcaaattgccgggctggctgaacattttccacgacaacatcgtctccacggcgattgtgatgaccatcttctttggtgccattctgctctccttcggtatcgacaccgtgcaggcgatggcaggcaaagtgcactggacggtgtacatcctgcaaactggtttctcctttgcggtggcgatcttcatcatcacgcagggtgtgcgcatgtttgtggcggaactctctgaagcatttaacggcatttcccagcgcctgatcccaggtgcggttctggcgattgactgtgcagctatctatagcttcgcgccgaacgccgtggtctggggctttatgtggggcaccatcggtcagctgattgcggttggcatcctggtcgcctgcggctcctcgatcctgattattcctggctttatcccgatgttcttctctaacgccaccatcggcgtgttcgctaaccacttcggcggctggcgtgcggcgctgaagatttgtctggtgatggggatgatcgaaatctttggttgcgtctgggcggtgaaactcaccggtatgagtgcctggatgggcatggcggactggtcgattctggcaccgccgatgatgcaaggcttcttctccatcggtatcgcctttatggccgtcatcattgtaattgcactggcttatatgttcttcgctggccgcgcgctgcgcgcagaagaagatgcagaaaaacaactggcagaacagtctgcttaataaggagttttgattatgaccgtacgtattctggctgtgtgtggcaacggacaaggcagttccatgatcatgaagatgaaagtggaccagtttttaacccaatcaaacattgaccatacggtaaacagctgcgcggttggcgagtacaaaagcgagttgagtggcgcggatatcatcatcgcttctacgcacattgcgggcgaaatcaccgtgaccggcaacaaatacgtggttggcgtgcgcaacatgctctctcctgccgactttggcccgaaactgctggaagtgatcaaagagcatttcccgcaggatgtgaagtaaggacgcgccatgaaattacgtgattcgctggcggaaaataaatccatccgcctgcaggctgaagcagagacatggcaggaagcggtgaaaatcggcgttgacctgctggtggcggcagatgtggtagagccgcgttactaccaggcgattctggatggcgttgaacagttcggtccttatttcgttatcgctccgggcctggcaatgccgcacgggcgtccggaagagggcgttaagaaaaccggtttctctctggtaacgctgaaaaagccgctggagttcaaccacgatgacaacgatccggtggatatcctcatcaccatggcggcggtcgatgccaatactcaccaggaagtgggcatcatgcagatcgtcaacctgtttgaagatgaagagaattttgaccgtttacgcgcctgccgtaccgagcaggaagtactggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctgtgcgtgggcgaaggcgtgcgtgcggttcgtgacctgaaagcgctctacccgcacaaaatcgtactggcagacgccaaaattgccgatgcaggcaaaatcctttcgcgtatgtgcttcgaagccaacgctgactgggtgacggtaatttgctgtgcggatatcaacaccgccaaaggcgcgctggacgtggcaaaagagtttaacggcgacgtgcagatcgaactgaccggttactggacctgggaacaggcgcaacagtggcgcgatgcaggcattgggcaggtggtttatcaccgcagccgtgacgcgcaggccgcaggcgtggcgtggggcgaagcggacatcaccgcgatcaaacgtctttccgatatgggcttcaaagtcaccgtcaccggaggcctggcgctggaagatctgccgctgttcaagggtattccgattcacgtctttatcgcgggccgtagtatccgtgatgccgcttctccggtggaagccgcacgtcagttcaaacgttccatcgctgaactgtggggctaaggagcggatatgttgtccaaacaaatcccgcttggcatctatgaaaaagcgctccccgccggggagtgctggctggaacgcctgcaactggcaaaaacgttaggcttcgattttgtcgaaatgtcggtagatgaaactgacgatcgcctgtcgcgcctcaactggagccgcgagcagcgtctggcgctggtcaatgcgattgttgaaaccggcgtgcgcgtgccgtccatgtgcctttctgctcatcgtcgtttcccgctgggcagtgaagatgacgcggtgcgggcgcaggggctggagattatgcgtaaagctatccagttcgcccaggatgtcggtattcgcgtgatccagctggcgggctatgacgtttactatcaggaagccaataacgaaacgcgtcgtcgtttccgtgacggcctgaaagagagcgttgagatggcaagccgcgcgcaggtgacgctggcgatggagatcatggattatccgttgatgagctccatcagcaaggcgctgggatacgcgcactatctcaacaatccgtggttccagctctacccggatatcggcaacctgtcggcgtgggacaacgatgtgcagatggagttgcaggccggaatcgggcatatcgtcgcggtacatgtgaaagacaccaaacctggcgtcttcaaaaacgtgccgtttggcgaaggtgtagtggatttcgaacgttgtttcgaaacgctcaaacagagtggctattgcgggccgtacctgattgagatgtggagcgaaacggcggaagacccggcggcagaagtggcgaaagcgcgtgattgggtgaaagcgcgcatggcgaaagcgggcatggtggaggcggcataatgcaaaagctaaaacagcaggtatttgaagccaacatggagctgccgcgctacgggctggtgacctttacctggggcaacgtcagcgctatcgaccgcgaacgcgggctggtggtgatcaagcccagcggcgttgcctacgaaaccatgaaagcggccgatatggtggtggttgatatgagcggcaaggtggtggaaggggagtatcgcccatcttccgacactgcgacgcatctcgaactctaccgtcgttacccgtcgcttggtggcattgtccatacccactccactcatgccaccgcatgggcgcaggcggggctggcgatcccggcgttaggcaccacgcacgccgactacttctttggcgacattccgtgtacgcgcgggttaagcgaagaagaggtgcagggcgagtatgaactgaacaccggcaaagtgattatcgaaacgctgggcaacgccgagccgctgcatacgccgggaattgtggtgtatcagcacgggccgttcgcctgggggaaagatgctcacgatgcggtgcataacgcggtggtgatggaagaagtggcgaaaatggcgtggattgcccgcggcattaacccacaactcaatcacatcgacagcttcctgatgaataaacacttcatgcgtaaacacggtcctaacgcttattacgggcagaagtagaacacgcgctgcggaaatttccttcctcgggagataactggtctaattccgcagccgtttttcaaaaaaaagccccctgcgaagggggcaaagcaaactatggcaatgtttcgttggttatacctggtgctagcgataaatatccgcgctggcgtgcatattgccgttactccccggttcccgcatcagaattacgtggtagtacgttgcgccttgcgcatctgtttcttcatttaatgcctgacgtgcttcgctttcagtggcgaaattatgattgatataaatcacgcctaagctttgcacatcgtccatatttctggcctggtggttattaatttcaatggctgcccatgtatttgcacttagcaaaagcacagccagaagggctaaaacacgactgaacatagatacctcctcgacggctgactttgtgtgctctcctctgtgatgatcttctgatttaattttaatcaatgataaagaagttgatggtgaccatttctgatgcagttgttcaaaaaaacaccatgatgaagtgtgatgaacttcaaatcagcgtgttagaggttaattgcgaaaggggagatttatttcggctctgcccttgagtttagcgaggcatacaagtactataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaatgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcagggctccccttcgaaaggtcagtccatcaggaattcctcactgccagttcgtgcttgagcatcgttctgtgcaggaggaagccggctttcaccggcaggcgtggtgtcaaatgcccgttattgttagcggacacgaaaaccaggccattactcacagtataacggtcggcagtcgcataaccgttcaggggttcatttcatgccacaaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagctcgtcgcgctgaactggaagctaaactggctgaagttctggcagctgctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccattggtcggcgttttgctttctatttttcgtcaggtattagtttcgcaagtagatccattcaccattctcttgtgtccataagtcaggatggtttgctggcgttagatacatacgagcgcaactgatgtctcgctcctgcggcactcgctcgaaacccaaacccgagtagattgcggctgaacttgataaggaacgcagaccaattttcaaatcatggggtaaatcagaatacgcgtttagcaatgcagcaatgatgaatccgagggcattagaaacgcctgtaacagtgcgaagttggtcgatataaagatcgattgttggtagttcagatgaccagcaattaggcatttgggcaggaagggttacaacgtatcctatcgtttggccggtatagtctggagtaccataaccaggtcccaaaaccacttcgtgtattgtgtatttactgttgggttcgaaggattcgacatcttgcaataaatatttcagttctgcggttaacctcgcacccgcgtaagctttattgtatttctgggcgtgaatattatctaatgtagcttcatggttccatccaaaagaattatcaccattcattgtgattccatcgtaagcattacacctcgtcgctaacttattgaatgcttgccagtctgagagatctagtttgtggatctcaacagtacgtctgccatcgcaattatgatctcttccacgatttgaaagtaatgtagcgcgtgcgtattgatgaaattttaattttactggtttgtcggtggacgaaaaacgagataaatatgcaggaaatgaataaatagtcgttggtaatgtcattgtaatgttacctgtttaatgtttttataaatatcgcagctgaatgttcacagaaaaaaatcgatattaataaaaataagtttgttttctgaagtggtgaaaatagcggatggtgaaagatattaatatcaaaaatcgctcattatggatataacgatgcacccggggagaaaatgacttccacgccttacaccgtacattcttgttgtgcggtatgtaattattctacgctgtcggtatcggtgtattcgttaatcagcaggttagccagccacaaaaagccattgagaaaattattgattttacatgggattattatattgctaatccttggtttttaaaaattgtgcatagtgaaaatcaaagtaaaggtgtgcattatgcaaaatcacagcgtctcttagaaattaaccatgcgcacttgcagttaatggaatccttattggatgaagggaagaaacacaatatttttaagccagatatcgacccattgcaggtgaatattaatattgctgcgcttggcggatattatttgatcaaccagcatacgcttggcctggtttatcacatcagtatggtttcaccccaggcactggaagccagacgtaaggtcatcaaagagacaatccttagctggcttttggttgacccttcatctaccgcgcacgaataaaactgccatccggctggcgggtgaacaggacctgttgattattccccgtatcaatggttaagcccgtcaccacgccgctggcgttctggcggattttcaccatctgcccgttttgcaaattactcagcggcttacccgcgccttctacctgcgccattgcatagacatcggtagcgggcagtccgtggtcgcggaacagctgcgccatcgttttaccgggttcgacacggtaagagcgccattgattatcaattccgctatctggctggaatggttgcgtttgggtagtttgcggctgctcttctggctggccttcctgtataggttctggagcgaccggagccacctgatcaggatcattttgtggggtaactaattgcgcccgcagctgttcttctgtcggcggttgtgattgcgactgaatatctaactgcgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccctgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaattcccggttaatggcgtgatccctggctggattgaagcactgactctgatgccggtaggttctaaatgggaactgactatcccgcaggaactggcatatggcgagcgcggcgcaggcgcatccatccctccgttcagcaccctggtgtttgaagtcgaactgctggaaatcctctaagcagcgcattctgttcccctcgaacgagaggggagcaggcattcagcaataaacccttcagtttgccaaacggcgctattttgtgttgcaaagaccccgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcaggctccggctgaacagtcgctacggcgcaatctcacaaaccgacatattcagcttattgccattggcggtgccattggtacggggttgtttatggggtctggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagacgtggtggcgatcacggcttatgctcagttctggttccccgatctctccgactgggtcgcctcgctggcggtgatagtgctgctgctgacgctcaatctcgccaccgtgaaaatgttcggtgagatggagttctggtttgcgatgatcaaaatcgtcgccattgtgtcgctgattgtcgtcggcctggtcatggtggcgatgcactttcagtcaccgactggtgtggaagcgtcattcgcgcatttgtggaatgacggcggctggttcccgaaaggtttaagtggcttctttgccggattccagatagcggttttcgctttcgtggggattgagctggtaggtacaacagctgcggaaaccaaagatccagagaaatcactgccacgcgcgattaactccattccgatccgtatcattatgttctacgtcttcgcgctgattgtgattatgtccgtgacgccgtggagttcggtagtcccggagaaaagcccgtttgttgaactgttcgtgttggtagggctgcctgctgccgcaagcgtgatcaactttgtggtgctgacctctgcggcgtcttccgctaacagcggcgtcttctctaccagccgtatgctgtttggtctggcgcaggaaggtgtggcaccgaaagcgttcgctaaactttctaagcgcgcagtacccgcgaaagggctgacgttctcgtgtatctgtctgctcggcggcgtggtgatgttgtatgtgaatcctagtgtgattggcgcgttcacgatgattacaaccgtttccgcgattctgtttatgttcgtctggacgattatcctttgctcgtaccttgtgtatcgcaaacagcgtcctcatctacatgagaagtcgatctacaagatgccgctcggcaagctgatgtgctgggtatgtatggcgttctttgtgttcgtggtcgtgttgctgacactggaagatgacactcgccaggcgctgctggttaccccgctgtggtttatcgcgctggggttgggctggctgtttattggtaagaagcgggctgctgaactgcggaaataaccgcattatcatgctggatggcgcaatgccatccagcttttagatcactcacccgccagcgcgcgtgggaacagtacattgttttccagactgatgtgatccatcaggtcatcaatcagttcattaatgccgttatacatcgctttccaggtggtgcaggcttctggcggcggtgtgacgttattggtggtgtgtttaatcacttccagcagttcgcccgcttcatcgtgctcgctttccattacgctgattggccccattgcctggctgcccatgccttgtttgatcatcgggaagaggatctgctcttctttcatcatgtggctggaaagctcttcatgcagcatggtcaggtattttgtcagcccttttggcacgctcggtttgtcggcgtgaacgcgctcgactttagtcgcttgcagaatcagctccggcagttgctcgcggtgacgatcgtggtagcgcacgatgatatggtcgatgatttctgccagcggggcgctacgccagtctttctcaatcggttgttcagcgagctttgccagttcagcttcaatgacctcaacatccagttctttacgtgccgccgcgcgcgccagcgtctgcttaccgccacagcagtaatccatatcatatttacgaaacagagctgaagcgcgaggaatagagagcgccagttcacctaaaggttggtcgcgataagccatagctgatacctcattcttaataagataagatgtattttaaatgcatctttaaggcaaaagctataacccttacgtagcagaggcttatttaactcactgccagcgtgtcaactttctgagacagattcagttaaaggtttttctggttttgctctgaccgcgatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatagctggctggcgacgttccagcagagtgcgccaacccatgagcaaagcacggctatcgcaaccatcagactaataaacaccagcggacgggggccaaagggtagggagaagtccggcgtttgcgtattcagccagtaacaagcgacgagatagccgataagtgaaaccggcagtgtgaccagcgcctgcgctgttgcccacatcatcggatgtttgtcgggattttcccgcagccagcgggcgttgcgcagggcataccacgcccagcagaccacggaaactaacgccagcacgatgccagaggtataacgtgcccagtcaaaatcggggagtccgtggtttaactcagcaatattcacacacgccaggccgatgccaatacaaatcagtgctggggcgagttttccccacgcgagtttgccgtcgcgctggctataaagcagattggcaaagacaggaatgaccaccggcagggtgccgataatcatcgtggaaacaggcgcgccagtacgttgaatggcactggcaaggcagaagtaatagatgaggttgcccatcatagtgagcatcaaggcggtaagccagtcgcgacgcgccaactgacgcagacgcacgcgtcccagccaggcaatgggcagcgcaattaaccctaacgccagataacgccccatcgactgcaacatcgccgggtattccggcacgatcaacggcccgacaaaaataagcccccacatcaaccctgctaacagggcgtacagcacgccgctaatcattactggcatccattgatctgtcagaagaaagttcaggaagcagacatgattgctcccggcatcccgtcattatcagagaggatgcgggaggatgccactttaattaactagttattaacattaaaaagatggcttacgctttcggctaacgttgtcgttgggtggccaatcaatttgctaagtgttttgctgtcatcaaacagaccgcctttcgatgcgccaacgtcagaatccgccagcatatccgccagtccgtcgggcagtccgacgcttttcagtgccgcggcgaaatcggcttcgctcagattttgataggtaacctgtttgccgctctgtttggtcagctctgccgctaactgtgtcaacgtccaggcactatcgcccgccagttcgtaaaccttgccttcgtgaccggcttcgctaatcacgcgtgccgcagctgccgcataatctgcccgcgttgctgaggcgattttgccatcgcccgccgcaccgataaatacgccgtgttccagtgctgccggggcgctggcgaggtagttttcgctgtaccagccgttgcgcagcagggtgtaaacgatgccagaatcagccagcattttctccgtctcgatgtgctcatcggcgaggccgagcggggaggtatctgcatgtagcaggctggtataagcgataaatttcacgccagccgcctttgcggcattaataacattacgatgctgcggggcacgttgacccacttcgctggaagagatcagcagtagtttttccactccctgaagtgcagatgtcagtgcggcttcatcgccgtagtcagcctgacgcacggtaatgccttgtgctgccagggcttgggcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacctaaacttacttttagtaagtacgtacaaaaaggtaagtatgaaatgagtcaggttagcctgtcgcaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttggcggtgcgggatgaacgtgcggcataactgccggatgcgctgagcttatctggtctacggtgcatggcttgtagggcggataagatgcgccagcatcgcatccgccaataaatgccggatgcggttgatgatttataggccgaaaaagaagtgttttacttactcaaatccacctgataaatcgcaaacccgatatcatcggtcgcgactttattcatcggatactgccctttctctttaataaacgctgcggctttatctgacggagaggtttcgaaacggatatccagtttcttatcgccagctatcggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaaccaggaacatggcgttcggatcaatcggcttgccattaaaggtcaggttcttaatcctttccgcattggcattaatcatctggcactcgccgtcataacgggcgggctgggtaacatcaatctgataattcacaccatcaataacatcaaagttataagtgcggaaaccatcccagttgatgagtgactgtggtttcgtgctgttgggatcaatctggttaaactgtcccgcggagcactccagccactctttcacctctttaccgctggctttcaccacaatcagcgtattgggatagagataaagatcggcggcattacggaaggtcaactggcctttttccacctccacatagcttgccgggtcatttttgcgaccaccgactttaaacggtgcggcagctgaaagcaccggcagttttgccagatccggatcgccctgaatgtaatgctcgacatacgctttttgcgcgttgttcaccacctgcacggtcggatcgtcctgcaccagcgccagatagctatacatattgtcggcagatttaccgattggcttgctgacgaactggcgtgtggcatcgtgatcggctttgagtgtttctaccagcttgctgtcttccgccgcgagggattttttattagcgatgtcgtaaatcggtcgtgcttccgctttcgcctgcgtcacctgccatttaccgctgtcattactgagttgtaagtcgaccacaccaagatgatcgccccacatgcctggcattaccgccggaacaccattcagcgtgcctttggcgatatcagccccttcgatatcagcaaaatctttacctgggaaaacggcgtgagcatggccaaacataatggcgttaacgcccggaatttcactgaggtaataaactgagttttccgccatcactttatacggatcggcagatagcccggaatgtgccagaacgacaacaacatcggcacctttctcgcgcatttcaggcacgtatttgcgcacggtttcggtaatatcattcaccgtcactttcccggataaattagctttatcccagcccatgatttgtggtggcacgacgccaatatagccaatcttcagcgtctgtttttttccgtctttatcgaccacttcggtgtctttaattaaatacggtgtaaacattggctgtttggttctggcgtcaatgacgttggcatttacataagggaatttcgctcctgccagcgcatttttcaggtaatccagaccgtagttaaactcgtggttgccaagcgttccgacggtatagtccagcgtatttaatgccttatagaccgggtgaatatcacctgcttttaatcctttcgccgacatgtaatcggccagcggactcccctgaatcaaatcgccgttatcaaccagtacgctgtttttcacttcattgcgggcatcgttaatcaggcttgccgtacgtaccagtccgaatttttccgtggcggtgtctttgtaataatcgaaatccatcatgttgctatgcagatcagtggtttccatgatacgcagatcgaccgtcgctgcattcacactggcggcaatcagcgtggccaggagcgttgcgctaaacttaatcatcagggacatccttttatcatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatgttccggtcctttctgaagaagatcctcccggttgggaagtccgtcagcactggcagcgttactggctggtagacccgctggatggtactaaagagtttattaaacgtaatggcgaattcaccgttaacattgcgctcattgaccatggcaaaccgattttaggcgtggtgtatgcgccggtaatgaacgtaatgtacagcgcggcagaaggcaaagcgtggaaagaagagtgcggtgtgcgcaagcagattcaggtccgcgatgcgcgcccgccgctggtggtgatcagccgttcccatgcggatgcggagctgaaagagtatctgcaacagcttggcgaacatcagaccacgtccatcggctcttcgctgaaattctgcctggtggcggaaggacaggcgcagctgtacccgcgcttcggaccaacgaatatttgggacaccgccgctggacatgctgtagctgcagctgccggagcgcacgttcacgactggcagggtaaaccgctggattacactccgcgtgagtcgttcctgaatccggggttcagagtgtctatttactaaattcagatggcagaaacagtgtatttcctgattctgccatcctgatttctcccaacctaaaaagttataaataaaaagagattgtatttaaagtgcaaaaattcaattgctaataagttacattttaataatgagcgttttttgatagtttacttctatagtgagatatttaatggcgacataaagtaaccaaataaaataaggttgtcatatgttacccaggatcagacacaataattttattggtgcggtggagttatttgtaaagtcttcgtatacaaaaacacattcaaacaatttttttaacaacatccatcatgcatttaagaaaaaagattggatttcgaattatgatagcctgttaactttgagggagttctttcgttgcgcaactcagattgataaaagtggttatcaggtgctttcatcaaaaaatgaaactgttcacgccatggataagtttcttatcagtttcagccttaaagataacggtgccgaatatacaatgacattgcgaggtagtggatttgaatacgaagaaatacccataacaataaatgaatataactcattcatggatttcaaaaaccgtgaatttccgttagaacaaaacagacgattgtatgcctgggatattctacagaaaaaacagtctgacataccgaaaaggattaaaggttatattcaccaggcgattggtgacgtgtctttaggttatgccttattggaggatatagtaagcaaattaaaacggggtaaatttgaactccaaataccaggaggtggaattaaagaatgcgatggatggtatatttacgaaaaaataattgatgataattttgccatagtcatagaatctttgggctttgcgcttaaaatctatggaggggatgaacgttttcgtaatggttcctctgttgttttggaggatgaagattactctcttatttataattttctggttaatgcaggttgccaacaagtcgaattagccgaacaagtggatgcgatagtaagtgcgaatctggccgcagatagcgatattaccaaagaaaagatttgcgagaaatataaatcgaccattgaggcgtttaaaaaagagcaactagcgttaccagtattagttcggcgtaagaactcagagacttaattcccctatcccatagataacgataggggaaaattatttttgcagaatttatgttattgccattatttgagcaacttttgcagcaggtccatcacttgctgcacctcttccggtgtgagcgccccgtctttggcccattgcacgcgaccatccttatccagcaccactacagcggaactttcttcatccagctgccaggcaccgagcgcgacgccattgctatcgacaataaactgcgaccagggataaagctttttattactctccagactgctgcgcacaaacatccctgaacccggaatcgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccccgatcggtaatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaagcattaaaatttgcgcctcataatagttgggccgattgtggcaccgcacaggcgtaatactcagcaggagataacaatgaaaattttccaacggtacaacccacttcaggtggcgaagtacgtaaagatcctgttccgtggacggttatacatcaaggacgttggcgcttttgaattcgataagggtaagattcttatcccaaaagtgaaggataagctgcatttgtcagtgatgtccgaagttaaccgtcaggttatgcgtctgcaaacagagatggcttaaccaaagtgctatgcagtaaaaagtgctatgcagtaataagacggctcctgattcaggagccgttgatgtttctgggggttacgcgacgctttcttctttatctttagcgtcaggcagttttggcgaaagggcggtggccttgctgtcgatccgggtcaccagcagctggtcgatgcggtagttatcgatatccaccacttcaaatttgtagccggcgaatttcaccgaatcggtgcgtttcgggatcttacgcagcataaacatcataaagccgccgatggtttcgtagttgcccgactgcgggaactcgtcaatatccagcacgcgcatgacgtcgtcaattggggtgccgccgtcaatcagccatgagttctcatcacgggcgacaatctgctcttccagcccctgaccgaccagatcgcccatcagcgtggtcatcacgtcattgagggtgatgatccccaccaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacataaccgatgatgtggtcaatatcttcattacagacgaggaacttagagtgcggatgttccgccaccttattcttcaggctttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatgtcatcagaagtgatgtcatctttacgtaccattggcagtttgaaaatacggaagattatgttcgccaggccgttgaagaaccacaccagcggggtgcaaacgtacaggcagaagcgcatcgggttgatgatacgcaaagccacagcttctggcgcaatcataccgatgcgtttcggggttaaatccgcaaacaggataaacatgccagtcactaacgagaaagagagaataaagctcagttgctcagagagctctgccgacatatagcgggagaacaggctgtgaaaagctggagaaaatgccgcatcaccgacgataccgccgagaatcgccactgcgttcagaccgatttggaccacggtaaagaacatgccgggattttcctgcatattcagaacgcgttgggcatttatattgccttcatcagccagcagtttaagtttgattttgcgtgaggcggcaagcgagatctcggacatcgagaagaacgcacttacagcgatcaagcagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagccgccagagggttaaaattcagacagctgaaaaatgcaaaactgcctgatacgctatgccgatcaggcctacgcagtccttgcaatatattgaatttggacgattttgtaggcctggtaagtcgtttacgccgcatcaggcatagacaaagagcactttatcaacaaactacatttgtacccgtaacgctatgcttccggcggcagacagacgccaattccgccaattccacagtaaccatacgggtttttatgcagatattgctggtggtcatcttcggcataataaaacggtgtggcgttagcgatttccgtggtgatgtgacgatcgtcatcggcggcaagcatcgccgcctgaaaacgttccagactggcgcgagctgcggcatcctgttctggggtcagcggataaatcgctgaacgatactgcgtgccgtggtcattgccctgacgcattccctgggcgggatcgtgattctcccaaaatacctgtagcaactgctcatagctgatgacggaaggatcgtaaacaatgcgtaccgcttcggcatgacccgtatcaccggagcacacttcccgataagtcggatttggcgtatagccgccggtatagcctgcggcggtgctgtaaacgccgggtaactgccagaacagacgctccacaccccagaaacaacccatcgcaaaaatggcaatctccattccgtcaggtacattggtcattgagtgaccgttgaccgcatgcagcgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatatttggggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctggaaaagaacgttcgtgcgcagctttctacgattgaaagtgatgaagtgacgccagaccgtcgctttcgcgcacgcgtcgatgatgccatccgcgaaggtctgaaagcgctgggttattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggcacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgccgactttctgctaccggctggtttaactcggtggtggtggctccacaatttgataaagcgcgcgaaacgaaagtattaccattgacgggcgtggtttcgccgcgaacagaaaacaccatcgaaaccggggtcggttactctacggacgtgggaccgcgcgtgaaagcgacgtggaaaaagccgtggatgaactcttatggtcacagtctgaccaccagtactagtatttccgcgccggaacagaccctcgacttcagctataaaatgccgctgctgaagaatccactggaacaatattatttggtgcagggcggttttaagcgcactgacctgaacgataccgaatctgactccactacgctggtggcttctcgctactgggatctctccagcggctggcagcgtgccattaacctgcgctggagtctcgaccactttactcagggtgaaattaccaataccacgatgctgttttatcctggggtgatgattagccgcacgcgttctcgtggtggcctgatgccaacctggggcgactcgcaacgctactctatcgactactccaacacggcctggggttcagatgtcgatttctccgttttccaggcgcagaacgtctggatccgcacactgtacgatcgccatcgttttgttacacgcggcacgctgggctggattgaaaccggtgatttcgacaaagtaccgccggatctgcgtttcttcgccgggggcgaccgcagtattcgtggctacaaatacaaatctatcgctccgaaatacgccaacggtgacctgaaaggggcctcgaagttgataaccggatcgctggaataccagtacaacgtgaccggaaaatggtggggcgcggtgtttgtcgatagtggcgaagcggtaagcgatattcgccgcagcgactttaaaaccggtaccggggtcggcgtgcgctgggaatcgccggtcgggccaatcaaactcgattttgccgtaccggtcgcggataaagacgaacacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgcgatctcaccttgtctgacgttcgttatgagcagccaggcgtggcggtaaaagcgggcaatctgcatctggctgtcgggcttgagtgcctgtggaacagcagtgtttgtattaatgatctggcgctgaaagacattcaggtcaacatcgacagtaaaaaaatgcctccttctgaacaggttgaagaagaggaagatagcggtccgctggatctctccacgccgtatcccatcaccctgacacgggtggcactggacaacgtcaacattaagattgatgacaccacggtatcggtgatggacttcacctccggcctgaactggcaggagaaaaccctgaccctgaaaccgacgtcgctgaaaggcctgctgattgctctgccgaaagtggcggaagtggcgcaggaagaagtggtcgaaccgaaaattgaaaatccgcagccggatgaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgattccagtcaagggatcgtcaacgccagcggcacggcgcagctgtcagacaactggccggtggacatcactctcaacagtacactgaacgtggagccgttgaaaggtgaaaaagtgaagctgaaaatgggcggcgcgctgcgcgaacagctggagattggcgttaatctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacacgctctctatgcgtacggcagtgaagggacaggagatcccgcccgcgactattaccctcgacgccaaaggtaatgaacagcaggtcaatctcgacaaactcaccgtcgcggcgctggaagggaaaactgaactcaaggcgttgctcgactggcaacaggccattagttggcgcggtgagctaacgcttaacggcattaacaccgccaaagagttcccggactggccgtcgaaactcaatggcttgattaaaacccgcggtagcctgtacggcggcacctggcagatggacgtgccggagttgaagctgaccggtaacgttaaacagaacaaagtgaacgttgacggcacgctgaaaggcaacagttatatgcagtggatgatcccagggcttcatctggaactcgggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtggcgcaggttcgcgtggaaggcgatatcaaatccaccgatcagatcgccgggaaactcgacgtacgcgttgagcaaatttcgcagccggatgtaaatatcaacctcgtcaccctgaatgccaaaggcagcgaaaagcagcacgagctacagttgcggattcagggggagcctgtctccgggcagcttaatctggcaggaagttttgatcgcaaagaagaacgctggaagggaactcttagcaatacccgcttccagacgccggttggcccgtggtcgctgacccgcgatattgcgctggattaccgcaataaggagcaaaaaatcagcatcgggccacactgctggcttaacccgaatgcggaactgtgcgtgccgcaaactatcgatgcgggggccgaagggcgtgcggtggtgaatctcaaccgcttcgacctcgccatgctgaaaccgtttatgccagaaaccactcaggccagcggtatcttcacgggtaaagcggacgttgcctgggacaccacgaaagaggggctgccgcagggcagtatcaccctttcggggcgtaacgtgcaggtaacgcaaaccgtcaacgatgcggcgctgcccgtggcgtttcagacactgaatctgacggcggaattgcgtaacaaccgtgccgaattgggctggaccatccgcctgaccaataacggccagtttgatggacaggtgcaggtgaccgatccgcaaggccgccgtaatcttggtggcaacgtcaatatccgtaacttcaaccttgcgatgataaaccccatctttacccgtggggaaaaagcagcggggatggtgagtgccaacttgcgtctgggtggtgatgtgcaaagcccgcagttgtttggtcagcttcaggttacgggtgtggatatcgatggcaactttatgccgtttgatatgcaaccgagccagcttgcggtcaactttaacggtatgcgctcgacgcttgccggtacagtacggacccagcagggtgaaatctacctgaacggtgatgccgactggagccaaattgaaaactggcgggcgcgggtaacggcgaaaggcagtaaagtgcggatcaccgtgccgccgatggtacgaatggatgtatcgccagatgttgtattcgaggctacaccaaacctgtttaccctcgatggtcgcgtggatgtcccttgggcgcgcatcgtggtgcacgatctgccggaaagcgcagtaggcgtctccagcgatgtggtgatgcttaacgataacctgcaaccggaagagccgaaaacggcgtcgattccgattaacagtaacctgattgtccacgttggcaacaatgtgcgcattgacgcctttggcctgaaagcgcggctgacgggcgatctcaatgtcgttcaggacaaacaagggctgggtctgaacgggcagatcaacatccctgaagggcgcttccatgcctatggtcaggatctgattgtgcgtaaaggtgagttactgttctctggtccgccagatcaaccgtatcttaatattgaagctattcgtaacccggatgctacagaagacgacgtaatcgccggagttcgcgtcactggtctggcggacgaaccgaaagcggagatcttctctgacccggcgatgtcgcaacaagctgccttgtcttatttgctacgtggacaagggctggagagcgatcagagcgacagtgcggcaatgacctcgatgctgattggtttgggggttgcgcaaagtggccagattgtgggtaaaatcggcgagacgtttggcgtaagcaatttagcgctcgacacccagggagtaggcgactcctcccaggtagtggtcagcggctatgtattgccaggtctgcaagtgaaatacggcgtgggtatatttgactctatagcaacactcacgttacgttatcgcctgatgcctaagctatatctggaagccgtgtctggtgtagaccaggcactggatttgctctatcagttcgagttttagcaatgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacggtacacggtgaagtttatcgtattgacaacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaaccatatgcatacgccaccttcgggtggcgttgttttttgcgagacgactcgcattctgttttgtaattccctcaccttttgcttttctctccgagccgctttccatatctattaacgcataaaaaactctgctggcattcacaaatgcgcaggggtaaaacgtttcctgtagcaccgtgagttatactttgtataacttaaggaggtgcagatgcgtattaccataaaaagatgggggaacagtgcaggtatggtcattcccaatatcgtaatgaaagaacttaacttacagccggggcagagcgtggaggcgcaagtgagcaacaatcaactgattctgacacccatctccaggcgctactcgcttgatgaactgctggcacagtgtgacatgaacgccgcggaacttagcgagcaggatgtctggggtaaatccacccctgcgggtgacgaaatatggtaaagaaaagtgaatttgaacggggagacattgtgctggttggctttgatccagcaagcggccatgaacagcaaggtgctggtcgacctgcgcttgtgctctccgttcaagcctttaatcaactgggaatgacgctggtggcccccattacgcagggcggaaattttgcccgttatgccggatttagcgttcctttacattgcgaagaaggcgatgtgcacggcgtggtgctggtgaatcaggtgcggatgatggatctacacgcccggctggcaaagcgtattggtctggctgcggatgaggtggtggaagaggcgttattacgcttgcaggcggtggtggaataaggtgtgtttatttatcgcgggcataaaaaaacccttactaaccgaagcccggcgttcagggttattacgccagaagaacttatttattctttgcgcgctcgaaggaggcaacgatttcagctttagcggcttctgcgttttcccaaccttcaactttcacccacttgcctttttcgaggtctttgtagtgctcgaagaagtgagcgatttgcgctttcagcagttcaggcagatcgttaacgtctttaatgtgatcgtattctttgctcagcttgctgtgcggaaccgcaaccagtttcgcatcttcaccggcttcgtcggtcattttcagaacgccaaccggacggcaacggatcacagaacccggctgcagcgggtacggagttgggaccagtacgtcaaccgggtcaccgtccagagacagggtgtggttgatgtaaccgtagttgcatggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtcttcgcttgttttcgtcttcattttcctttttcaccagttttaagacggtatacagagcaggaaaatccataaccgtagccgcatttttcatagtgagatgaaagcgattacaaacttgtgattaacgttttatttacttttttgaagtgtgatgtaacgcaatctgttacataacgaattgtctatagttttttcgcgaacatcttttaaccaataataactaccccgacgaggacaaccctatgtggaaacgcttacttatagtctctgcagtctcggcagccatgtcgtctatggcgttggccgctccattaaccgttggattttcgcaggtcggatcggaatcaggctggcgtgccgcagaaaccaatgtggcgaaaagtgaagccgaaaagcgcggaatcacgttgaaaattgccgatggtcagcaaaagcaggaaaaccagattaaagcggtacgttccttcgttgcacaaggggtggatgcgatctttatcgctccggtggtcgcgacaggttgggaaccggtattaaaagaggcgaaagatgccgaaatcccggtattcttgctcgatcgttccattgatgtgaaagacaaatctctctatatgaccaccgtcactgccgacaacatcctcgaaggcaagttgattggtgactggctggtaaaagaagtgaatggcaaaccatgcaacgtggtggagctgcagggcaccgttggggccagcgtcgccattgaccgtaagaaaggctttgccgaagccattaagaatgcgccaaatatcaaaatcatccgctcgcagtcaggtgacttcacccgcagtaaaggcaaagaagtcatggagagctttatcaaagcggaaaacaacggcaaaaacatctgcatggtttacgcccataacgacgacatggtgattggtgcaattcaggcaattaaagaagcgggcctgaaaccgggcaaagatatcctcacgggttccattgacggtgtaccggacatctacaaagcgatgatggatggcgaagcgaacgccagtgttgaactgacgccgaatatggcaggtcccgccttcgacgcgctggagaaatacaaaaaagacggcaccatgcctgaaaagctgacgttaaccaaatccaccctttacctgcctgataccgcaaaagaagaattagagaagaagaaaaatatggggtattgagggttgctatgcctgatgccgattcgtaggccggataaggcgctcgcgccgcatccggcgatggtgcactgaagcctgatgcgacgcttaccgcgtcttatcatgcctactgggagcacgctttacaccgggggaaaccatgacgaccgaccaacaccaggagatcctccgcaccgaaggattaagtaaatttttccccggcgtcaaagcgttagacaacgttgatttcagcctgcgccgtggcgaaatcatggcgctgctcggtgaaaacggggcgggaaaatcaacgctaatcaaagcattaactggtgtataccacgccgatcgcggcaccatctggctggaaggccaggctatctcaccgaaaaataccgcccacgcgcaacaactcggcattggcaccgtctatcaggaagtcaacctgctacccaatatgtcggtcgctgataatctatttataggccgcgaacccaaacgcttcggccttctacgccgcaaagagatggaaaagcgcgccaccgaactgatggcatcttacggtttctccctcgacgtgcgcgaaccgctcaaccgcttttcagtcgcgatgcagcaaatcgtcgctatttgtcgggctatcgatctctctgccaaagtgctgatcctcgatgaacccaccgccagtctcgacacccaggaagtggagttactgtttgacctgatgcgtcagttgcgcgatcgcggcgtcagcctgatttttgtcactcactttctcgatcaggtctatcaggtcagcgatcggatcaccgtcttacgcaacggcagtttcgtaggctgtcgggaaacgtgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatcgcaccgtttgatctcgaagtacgccccggcgagatcgtcggtctggctggattgctgggatcaggacgtaccgaaaccgccgaagtgatcttcggtatcaaacctgctgacagcggcacggcgttgatcaaaggcaaaccgcaaaacctgcgatcgccacatcaggcttcggtactgggcattggcttctgcccggaagacaggaaaaccgatggcatcatcgctgccgcctcggtgcgggaaaatatcatcctcgctctccaggcccagcgcggctggctacgtcccatttcccgcaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgatgagccaacccgcggcattgatgttggtgcccacgccgagatcatccgcctgattgaaacgctatgcgccgatggtctggcgctgctggtgatctcctccgaactggaagagctggtgggctatgccgatcgggtgattatcatgcgcgatcgcaaacaggtggcggagatcccgctggcagagctttccgttccggcgatcatgaacgccattgcggcgtaaggagaacagtgtgatgcctcaatctcttccggacaccactacgccaaaaaggcgctttcgctggccgacggggatgccgcagctggtagcactattgctggtgctgctggtcgatagcctggtagccccgcatttctggcaggtggtgcttcaggatgggcgtttgttcggtagccccatagacattcttaaccgtgcagctcccgttgcgttactggcgattggcatgacgctggtgatcgccaccggtgggattgatctctccgtaggggcggtgatggctatcgccggagccacaacggctgcgatgacggtcgcgggattcagcctgccgattgttttgttaagcgccctgggcaccggcatcctggcgggattgtggaacggcatactggtagcgatcctcaaaattcagccgtttgtcgccactctgatcctgatggtcgccgggcgcggcgtggcgcaactgatcaccgccgggcagatcgtcacgtttaactcgccggatctctcatggttcggcagtggatcgctgttgttcctgccaacgccggtcattatcgcggtgctgacgcttatcctgttctggctgttgacccgcaaaacggcgctggggatgtttatcgaagccgttggtatcaacattcgggcggcaaaaaatgccggggtaaacacgcgaatcatcgtcatgctcacttatgtgttgagcgggctgtgtgcggcgattgcgggcattatcgtggcggcggatattcgcggtgccgatgccaacaacgctgggttatggctggagctggacgccattctcgcggtggtgattggcggcggatcgctgatgggcgggcgctttaacctgctactttcggtggtgggggcgctgattattcaggggatgaacaccggaattttgctttcgggctttccgccagagatgaaccaggtggtgaaagcggtggtggtgctttgcgtgctgattgttcagtcgcaacgctttatcagtctgattaaaggagtacgtagccgtgataaaacgtaatttgccactgatgatcaccatcggcgtctttgtgttgggttatctttactgcctgacccagtttcccggttttgcttccacaagagtgatctgcaatatcctgaccgataatgcctttcttgggatcattgccgttggcatgacctttgtgatcctctcaggtgggatcgatctctccgtcggttcggtgatcgcctttactggcgtgtttctggcaaaagtgattggcgatttcggcctctcgccgctgctggcgtttccgctagtgctggtgatgggctgtgccttcggcgcatttatggggcttctgatcgacgccctgaagatcccggcatttatcattacgcttgcggggatgttctttttgcgcggcgtcagctatctcgtttcggaagagtcgattccgataaaccatcccatttatgacacgctctcaagccttgcgtggaaaatccctggcggcggtcgcttaagtgcgatgggactgctgatgttggcggtggtggttatcggcatattcctcgcgcatcgtacccgttttggtaatcaggtatacgccattggcggcaacgcaacgtcggcgaatctgatggggatttccactcgcagcaccactattcgcatttatatgctctccaccggactggcaacgctggcggggattgtcttctcgatttatacccaggccggatatgcgctggcgggcgtaggtgtggaactggatgctatcgcctcagtggtaattggcggtacgcttttgagcggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcaataaaaacgcctctccgtgtggagaggcgcaggagattacgcgtccgggaactcacggataaagcgttcgacatcttcaaccatatggtcgttgccgacaaagaatgaacggcgctggtgcagggtttccgggatgatatccagaatacgctctttgccatcgctcgctttaccgcccgcttgttccgccaggaatgccatcgggttgcactcatacagcaaacgcagtttgccgtccgggtggctggcggtgcttgggtagagataaataccgcctttcagcaggttacggtggaaatccgcgaccagtgaaccgatataacgtgaggtataagggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacgccgagcgaaggatcgtaagtaaaggcgtgaacaccgcatccggtggtgtaaaccagcatggtagaggagccgtataccacgtaacctgccgcaacctgtttgttaccaggctggaggaaatcttcttccgttaccggcgtgccaacaggcgtaacgcggcggtagatggagaaaatggtaccgacagagacgttaacatcgatgttggacgagccatccagggggtccatcagcaccacgtattttgcgtgttcacagccttcaaagacgacaatctcatcttcttcttcagaggcaatgcccgcaacgatatcgcgtgctttcagtgcggctttcagtttttcattagcgaacaagtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatctcaatgttgcgctcaggtgaatcgcgccagcaaattacggattatcctgaaatgcgtttctcacttgcccgacatatgcgtaaaatgagcggcagattaaaaaaggatagtgacgtatgcgcattcatattttaggaatttgtggcacatttatgggcggtctggcgatgctggcgcgccagttaggccatgaagtaacgggttcggacgccaatgtgtatccgccgatgagcaccttacttgagaagcaaggcattgagctgattcaggggtacgatgccagccagctcgagccgcagccggatctggtgattattggcaacgccatgacccgtggaaatccgtgtgtggaagcggtactggaaaaaaatatcccttatatgtcaggtccacagtggctgcacgattttgtgctgcgcgaccgctgggtgctggccgttgccggtacacacggcaaaaccaccaccgcgggaatggcgacctggattctggaacagtgtggttacaaaccgggctttgtaatcggcggtgtgccggggaactttgaggtttcggctcatctgggcgaaagcgacttctttgttatcgaagcggatgagtatgactgcgccttcttcgacaaacgctctaaatttgttcattactgcccgcgtacgctgatcctcaacaaccttgagttcgatcacgccgatatctttgacgacctgaaagcgatccagaaacagttccaccatctggtgcgtatcgttccggggcagggccgtattatctggccggaaaatgacatcaacctgaaacagaccatggcgatgggctgctggagcgagcaggagctggtgggtgagcagggtcactggcaggcgaaaaagctgaccaccgatgcttccgaatgggaagttttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaatgctcgtcgccgtctggagttgcgtggtgaagcgaatggcgtcacggtatatgacgattttgcccatcacccgacggcgattctggcaacgctggcggcgctgcgtggcaaagttggtggtacggcgcgcattattgctgtgctggagccgcgctcgaataccatgaaaatggggatctgcaaagacgatctggcaccttcattaggtcgtgccgatgaagtcttcctgctgcaaccggcgcatattccgtggcaggtggcagaagtggcagaagcctgcgttcagcctgcacactggagtggcgatgtggatacgctggcagatatggtggtgaaaaccgctcagcctggcgaccatattctggtgatgagcaacggcggttttggtgggatccatcagaaactgctggatgggctggcgaagaaggcggaagccgcgcagtaattcggccttagccagatatagtatgcgtaggccggataaggcgttcacgccgcatccggcatttgagcatagtgcctgatgcgacgcttgatgcgtcttatcaggcctacaggtgcaccgtatccggcaaaccatactcacatcaacaacgaaaattacccttcgttctccgctaactcgcgcagatactggaaaatctggcgtgcggatttcggcggcttattcccttctttctctttcttcgcgttgcggatcagagtacgcagttgctgacgatcggcatcgggccacagatttaatacctcagcgatggcgtcatcaccttgatcgatcagacgatcgcgcaggttttccagtttatggaacagcaccacctgctggttgtgacggtttttcagcttatccagcgcctgacgaataggctctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttccactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcactgtttatcaccagaaccgcaaaggtagcgcatcatccaccgatttaagcccgcaggccattgcccgtactgtacaggcggcgctggatattgcccgttatacctcgccagatccctgtgccggcgtggcagacaaagagctgctggcctttgacgcaccagatctcgacttgttccaccctgcggaagtttccccggatgaagccattgaactggcggcccgcgcagaacaggcggcattgcaggcggacaaacgcatcaccaataccgaaggtggcagctttaacagccactacggtgtcaaagtttttggcaacagccacggcatgttgcagggttactgctcaacgcgtcattcgctctccagctgtgtaattgccgaagaaaatggcgatatggagcgtgattacgcctacaccattggtcgtgcgatgagcgatctgcaaacgccagagtgggttggggccgactgtgctcgccgtactttatcgcgtctgtcaccgcgtaaactctccaccatgaaagcgccagtcatttttgccaatgaagtggcaaccgggctttttgggcatctggtgggggcgatagcgggtggatcggtttatcgtaaatctaccttcctgctggattcgctgggtaaacaaattctgccggactggctgaccattgaagagcatccgcatctgctgaaagggctggcgtcgacgccattcgacagcgaaggtgtgcgcaccgagcgtcgcgatattattaaagatggcatcctgactcagtggctgctgaccagctactcggcgcggaaactggggctgaaaagcaccggacatgcgggcggtattcacaactggcggattgccggacaaggtctaagcttcgagcagatgctcaaagagatgggcaccgggctggtggtgacggaattgatgggccagggcgtgagtgccattaccggtgattattcccgtggtgcagcgggcttctgggtagagaatggcgaaattcagtatccggtgagcgaaatcaccatcgcaggtaatttaaaagatatgtggcgcaatattgtcaccgtcggtaacgatattgaaacacgcagtaatatacagtgtggttctgtgctgttgccggagatgaaaatcgccggacagtaaaaaaactggcgcgacctgccgcgctataaactaaaaaattacacaaaatcattcgcactgcatcgagacggaaagtgaatgagggccggggagcgtactcgcagtacgtgacccggtcgaatgagcgtagtcgtcgatgaggcagtgtgaaggatgaagtgtaaataaaaaaggaactattcttgcagtctcctcgttggtattcagttcggcgtcatttgctgctgatctcgaagacaatatggaaaccctcaacgacaatttaaaagtggtcgaaaaagccgataacgcggcgcaagtcaaagacgcgttaacgaagatgcgcgccgcagcgctggatgcgcaaaaagcaacgccgccgaagctcgaagataaatcaccggacagcccggaaatgaaagatttccgccacggtttcgacattctggtcggtcagattgacgacgcgctgaagctggcaaatgaaggtaaagtaaaagaagcgcaggctgctgcagagcaactgaaaacgacccgcaattcatatcacaagaagtatcgttaattcctcatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttgtaccagtttcagaatatccggcacgttttgcggatgcagcggatcgccgccggagagggaaataccctggcgtttgatacgagtgtcattcagatcgttaatgatctggtcttccattgctttggtaaatggctgaccggaatttacccgccatgtgcttttgttatagcaaccggggcattcatgaacacacccggagacaaacagggtgcaacgagtgccggggccgttgacgatgtcgacaggatagtactgatgataattcattatttcgcctggcttatcagtccgcgtgtaggctgcatccggtaatcaatgcctgatgcgacgctgtcgcgtcttatcagacctggagcaattgccaaatgtaggccggataaggcgtttacgccgcatccggcatttgcttagctcagagtgaagattaacctatctgcccattccccaaatgtttaacgcggcgcttaacttcttcctgcttaccagcgttaaacggacgtgcatccgggctacctaaatatccgcacacgcggcgagttaccgacacacgggaggcgtcatggttaccacatttcgggcaagtgaagcctttgctggtgcactcgaactcaccggtaaagccacactcgtagcactcatcaatcggtgtattggtgccgtaatacggtacatgctgatagctgtaatcccagacatcttccagcgccttcaggttgtgctgaatgtttggatactcgccgtagcaaatgaaaccaccgttcgccagcggcgggtaaggcgcttcaaagtcgatcttgtcgtacgggttcaccttcttctccacatcgaggtggaaactgttggtgtagtaacctttatcggtcacgcccggcaccacgccaaactcagcagtatcgagacggcagaagcgatcgcacaggttttcactcggcgtgctgtagagactgaaaccataacccgtttcttctttccactgatccactgcctgacgcagacgttcaacaatggcgatacctttcgcgcgaagctgctcgttgtcgtaaacatgctcgccgccgaacagcgcgttaatggtttcgtggatgccgatgtaacccagcgaaatagacgcacgaccgtttttgaagatttcagaaacatcatcgtcagcattgagacgcacgccacaagcaccttccatatagaggatcggggccacgcgcgctttcacgccttcgagacgagcgatacgggtcatcagcgccttacgtgccagcaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcggagttttaaacgaaccggtgactttcactacctgatcgtagttcaggatatccggatacatgcgcttgcttgcgcactccagcgccagctgtttgatgtcgtagttcggatcgccttttttatggttcaggccatcgcgaatcgcaaacaccagtttcgggaacaccgcagttttacggtttttaccgaggcctgcgatacggttacgcaggatcgattcctgaatcaggcgcgattcccagctggtgcccaggccaaaaccaaaggttacaaacggcgtctgaccgttggcggtgtgcagggtgtttacttcgtactccagtgactggaaggcatcgtagcactctttgatggttcgagagttagcgtagccttcggcgtccgggatgttccactcttctgcggtcttgcgatgtttgttgtagctggcagtgacaaacggtgccagcacttcatcgatacggttaatggtggtgccgccataaatatggctggcaacctgagcaataatctgcgcagttaccgcggttgccgtagagatcgacttcggcggttcaatctcggcgttccccattttaaagccctgggtcagcatgcctttcaggtcgatcaacatgcagttgaacatcgggaagaacggtgagtaatcgagatcgtgatagtgaatatcgccacgctcatgtgcctgcaccacgtcacgcggcagcaggtgctgacgtgcatagtgtttagccacgatcccggccagcaggtcgcgctgggttggaatcaccttgctgtctttgttggcgttttcgttgagtaacgaggcgttggtctgctcgaccagaccacggatctcctggttcaggcgaccgcgtttttcacgttcaatgtcgcgatcgtgacggtactcgatgtaagcacgagccagttgtttgtatggacctgacatcagctgattttcaactgcggtctggatctcattgatatccacctggttgcggccctgcatctgctcgctgacaaccgcggcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgagctttttttgatgtagctcaaagtaaaaagcagagcgtacggatgacgggcgctacagcgatatgtaaattttttaatgaatttgctggttgaaaaatcaacaaaaacaacatactgacagacaaaaccccggaatgaccggcattaccggggcttagggaagatttacttctgtaaccaccagacagcctcaaaaggccgtaaattcatggcacagggttgtggtgaggcttcttcgtagttatgcatcacaagctgccagttgccgcgcatttgccctgcctgccagggttggatctcacggctaaggttggcaatgaccagcaaggtttgccccttccattcacggcgatagcaccacaatacagggctgtttggcagcagatcctggtaattgccccatgtcaggatggcttcctgcttacgcagtgcgattaacttttggtaggtgtaaaacaccgaggaatcatcggccagcgcggcttctacgttgatttgttgatagttatcgcccaggccaatccacggttcgccagccgtaaacccggcattatcgccgttgctccattgcatgggcgtgcgactgttgtcacgggatttactggcgaggattgccaataactcgtcggcatcacgcccatcgttgcgcagctcggcaaacatattgaggctctctacgtcgcgatagtcagtaatgcgcgtgaaatgcgggttggtcatgccaatctcttcgccctggtagatatacggcgttccctgcatgccatgcagcaccatcgccagcatttttgccgcaggcacgcggtattcaccttcatcaccaaagcgagaaacaatgcgcggctgatcgtggttacaccagaacaaggcattccatgctacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagagccgcgtatcgctggcaatgctcaaggctggtggaggacatttcacctacggtcattaacccgcgtggcgtaaacacatcgcggttcatctcgtgcaaaaactcgtgtgctcgtggcccgtcggtgtagaagcgacgcccgtcgccgtccaggtcttcagggaaacgcgggtctttggagatcagattcaccacatccaggcgcaacccgtcgaccccacgatcggcccagaactcacagacttttttcagctctgcgcgtaccgctggattctcccagttgagatccgcctgttctggtgcaaagagatgcaaatagtactgttcgctttccgcatgccagcgccacgcactaccgccaaattttgaacgccagttgttcggtggcgtttctggttctccatcgcgccagatataaaactggcggtaagggctttctttgttcagcgcctcgcgaaaccaggcatgttgggtagaggtatggttaaacaccatatcgagaatgatacgaatcccgcgcgattttgcctgcgtcaccagttcgtcaaaatcgtccagcgtgccgtaggtgggatcaatcgccgtatagttcgctacgtcgtaaccgttatcgacctggggagagacataaaagggggttagccagatggcatcaacgcccagtttatgcagatagtccaggtgttggataacgccacgtaaatcgccggtaccgctacccgtggtgtcctgaaaactctttggataaatctggtagataacgccgttttgccaccagtggggaagatgagtcattacgttattcctgcgaatgcgagggggcgcaattgcgccccgaagaaaattaaacaatgtccagcgtgcccaggcggtatttccgctgatagataaacgaggtgagtacaatcgggatgatgatggcgatagccattgccagcgcaaacacctgccagtagctcggttgaatcgagagaattcccggcaggccgcctacgccgatgccattcgccataacgccgttcaggccgcatagcaatcctgccagaccagaaccaatcatcgcgcacagcatcgggaagcgatatttcaggttgatgccgtacattgcaggctcagtgaccccaagccaggcggagatagcggcaggcacggagatctcgcgttcattgtgcttgcggctggaaatgataatgcctatcacggcggagccctgagcgatattcgacagcgcaatcagcggccacactggcgtaccacccatgctttgaatcatctgcaaatcaatagcaagcgtggtctggtgtacaccggtgatcaccagcggggcgtacaggaagccaaacaatgctgcgccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggtaccaccaccagatagaggtaatccggcacgatgcgtttaaggcgagtttcaataacgcccagcgccagtccggctaacagtgccgggatcacctgcgcctgatagcctactttggcgatgctgaacatgccaaagtcccacacttccggcagctgctgcccgagcagataagcgttcatcagctgtggagaaaccagtgtcacgccaagcacgataccaaggatcggcgtgccgcccatttttttcaccgctgaccagcaaataccgaccggcaggtagaagaagatcgcttcaccgatcaaccacagaaaatcgtagatcgtttgcagggaagggtacatttgcgccagcgtctgaccgttgctcatgggcaaatcgccgatcacattgcgaaaaccgaggatcaaaccgccgctaatcaacgcgggcagcaacgggaagaagatcaccgcgaaatgagagatcaactgctcatgccatttcatattatgccgggcggctttttttacctgctctttatcaacctgcgcctgtccggttgacgcaatcagtgcttgatagtaatcacccacgttggtgccaatcaccacctgaaattgcccggcattggtgaaacagcctttcaccatagggagttgctcaatttctttcggtctggcattggccggttggttgaggacaaagcgtaggcgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggttacctgcgcgatcaactggcaagccgcctggcgtccagcttcggcgtaaccgggatctacggttacgatctccggatggaggaatttcattaacggcgtattaccgacgctcgccagttgcaaggtgtcgatgcgttgctcttgcaggtatttacttgcgccaagtgccagcgtgtcggttgcgcacagtaaggcggtagtttcaggcgtaatcacttttgcaacgttctcatagccttgcttcatagcaagccctggcagggcggcaacgggatgcagtttatgcgctttgcagaacgccaggtaggcttcgtgacgtcgcttaccggttgtcacgtcactgtgcggcacgccgagataactgatattacgatgcccctggtcatacagccgttgcatcaggattttgattgccccttcgtcgtcataacagaccgaagcaaagccttttgcgtcacgcgccagcagaaccagcgatgactgccagtgggctaacatttcttctgttatgccagtaaaaccgaacagcactacgccgtcgatattacgccgtttcagcactcccaaatgttcggcaactaattgcggggaaaactgactttccatcatgattgggtcgtaaccttgttcatagaacgctggcagcatggtttgaacggcgagattttctgacaacgaatccagacgggtaacaatgatggcgaccactttatcgctttgcccacgcatagcgcgcgcagagcgggaaggggaaaatccatgctgattcatcactgcttcaacacgctcgcgggtgagctggctcacgccgctttcgttattcagcacccgggaaactgtagatttccccacgccgcttaagcgcgcgatatctttgatggtcagccgattttgcatcctgttgtcctgtaacgtgttgtttaattatttgagcctaacgttacccgtgcattcagcaatgggtaaagtctggtttatcgttggtttagttgtcagcaggtattatatcgccatagatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggctcattcgccatttaccttcccgtctggttcatcgtgatccattgcctggcgcgcagcagacagtgaatacggtggtcccgccgtccttaagtgcgcattgcctgaaaatggcggtgatgcccgaagaagaattgtggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgctgcgggcgttatcgcgctaatggtcgctatttctacgttgctgaactttattcaggaagcacgttccactaaagcggcagatgccctgaaagcgatggtcagcaatactgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtagaaaaagccgctaccactcgccagccggagcacagcaatccgctggagtgcgacacgctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggcaccggtggtgctgttaatcaatggttacaccaaaggcgactggtgggaagcggcgctgtttgcgctttcggtcgcggtaggcctaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaaccggcaccctgacgcaggataaaattgtgctggagaatcataccgatatctccggtaaaaccagcgaacgcgtgctgcatagcgcgtggttgaacagtcattatcagaccggacttaaaaacctgctcgatacagcggtgctcgaaggtacggatgaagagtcagcgcgctcgctggccagtcgttggcaaaaaattgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgcttttcttgatccgccaaaagagacaaccgctccggcactgaaggcattaaaagcgagtggaattaccgtaaaaatccttactggcgacagtgagttagttgcagcgaaagtgtgccatgaagtggggctggacgcgggagaggtggtcattggtagtgatattgaaacgctatctgacgacgaactggcaaatcttgcacagcgtaccacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtagcgagtgctttcttgcccttcctgccgatgttgccgttacacttgcttattcagaacctgctgtacgatgtgtcacaggtggcgatcccgtttgataacgtcgacgacgagcaaattcaaaagccgcagcgttggaatccggcggatctggggcgctttatgatcttcttcggaccgatcagctcgatcttcgatattttgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaattacaggcgctgccgttaagctatttcccgtggctggttgcgattctggcagggtatatgacattaacccagttggtgaaagggttctatagccgtcgttacggctggcaataaagaataaactgggcacgatagccccgattcagattgtagacaaagtgagttttgttcatgccggatgcggcgtaaatgccttatccggccaacaaattcaataaattgcaggaatcacgtaggcctgataagcgtagcgcatcaggcgattttgcgtttgtcatcagacttaatccgggcatgatagcccggatttccatcaagattagcgacgaacagcgatcgcttcgatctcaatcttcacgtctttcggcagacgggcaacttcaacgcaagaacgtgccgggaaggtggcgttgtgttcggtgaagaaggcttcgtaagtggcgtttacggttgcgaagtcgttcagatcttttacaaacacggtagttttaacgatgtcgcccactttcaggccagcggcttcgacgatcgcttttacgttatccagcgactgacgtgcctgtgcagcgacgtctgccggtacttcgcccgttttcggatttaccgggatctgaccggaggtgatgatcatattgcccagatcaacgccctgtacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgggaaaactctttttcacagtatttgcatttgagcgcgatatcattggcgcgttttcgcacggcaaagctggatgaaaccggttcggcatggctgatacagttgctgttcgggcagaccagcacattgtcgatgcgctccggcagacttgggcgcgatttacccaccacttcatagttgtcgatacggttaaccgtggcttgcggcgcatacaatgccagttgatctacttgatcttcactcaaaaaggtattttcgattttgatcagatctttgcggcccatctcgccagaaggcaggttcagaccaatggtgatgcgctgatccgtttcggtcagcttgaacagactcaacagcttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcctgctggaagtaccaggcgtgtggcgttttatcaacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagagctgtgcagactccatgcgatccctttttcatcgagcatatccagaatgtattgcggcattgccagcgcgtccggcgcgatgaagtaaaaacggttgccgtcgaacttcgctaacgcctgagtcagggagtgaacggtgcggccatatttcaggtcaccaaccattgcgacgtggagattgtccagacgcccctgggtttcctgaatagtgaataagtccagcaaggtttgcgtcggatgttggttggagccatcaccggcattcagtaccggtacattgccggaaaactcggtggccaggcgcgccgcaccttcctgcggatgacgcatcactatcgcatcgacgtaagtgctgataaccgaaatggtatcggccagcgtttcgccctttttacccagtgatgtattggcgctgtcggagaagcccaccacgctggcccccaggcggtgcatagatgtttcgaaagagaggcgggtacgggtagaggcttcgaagaaacagctggcaatgactttgtgcttcaacagctctggttgcgggtttgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcatcgtcagaagcggcgcaagcatttgatgcaatattttgtcagcgcaaacggtttatttgaattaaaagtcaaggtatatgcatttttatttgatgtgattctgcaggggaactgtccttcggtatcaataattgcagacattccctgctttttcctttttcactttcacgcaatcagatatgcattttattccattcatccgacttatagggcggagtgtgaaagcgaacggctaacactattgcttactgctcagggatgcgcgctatcactttaatttcaaaatcaaagcctgccagccatgtaacacccaccgccgtccagtttggataaggtggggcgctaaatatttcatttttcaccgtcatgatgtcttcaaattggttttctggatcggtatggaagctcgtaacatcaatgatatcgtcaaaagtgcatcccgcagctgccagggtcgcatgcaaattatcaaatgccagtctgacttgttgctgaaaatcgggttctggtgttccgtcctctcgacttcctacttgcccggaaacaaacagcaaatcgccggaacgaatagccgcagaataacgatgctcagcatatagtgaatgtcggccagcagggaaaacagcggttctttctaccatttggttatcctcaagatttacgacatgaacagaagatttctctttaccgggagccgcttttagcggacgacgtgagtaaacaaaacccagacatcatggataatggctgggcttaattgagcgtagtcggttatgcgccaaacgcgccatcaatggtatgcatcgcgccggtaacaaaactggcttctggccctgctaaccatgcgaccataccagcgacctcttccggttgcccatgtcttttgatagccatcaaactatgcaacatatcgcgcattggcccgttggcgggattagcgtcggtatcaattggccctggctggacgacgttaatggtgatcccacgcggtccaaaatcacgggccagcccgcgcgccatgccttgcagggcagatttgctggcggcataagcagccatgcctgcaacaggcatacgatcgccattcacggagccgatgattaagatgcgcccgccttcgggcatctgccgggcggcttcaacagaggcatgataaggagcatgaatattgattttgaaaaggcgatcaatatcgtcggcatttaattccagggcctcgccaaagacgccaatacctgcatttaccaccaggatatccaatgcgccgctcttacgaacgacatcaatgacagcgtctctgtcagcactatctgtgaatactgctgtcgctccagtctcttgtgccaggcgtttagcggcatctttcgaccccgcataggtgaatcgtacattggccccatcggtgacgaaacgacgtacgatagcggcaccgataccacgactgccaccgaggatgagaactgtcttacctgtaaaagcgcccataaggactccttgatttattatgtaacatgcattacaaaactgttttaactttctgtcaacaggttttgtaatggtcactaaaaaacaatctcgcgttccaggtcgtcccagacgtttcgctcctgagcaggcaatctctgcggcaaaagtgctttttcaccaaaaaggtttcgatgctgtcagtgttgctgaagttactgattatcttggtattaaccccccgagcctctacgcggcttttggcagtaaagctgggttatttagccgtgtactcaatgaatacgtcggtacggaagctattccgcttgccgatattcttcgtgatgatcgtccggtaggcgagtgcctggttgaggtattaaaagaagcggcgcgcagatatagccaaaacggcggctgcgctggctgtatggttcttgaaggtattcatagtcatgatccacaagcgcgtgatattgccgttcaatattatcacgccgcagaaacgaccatttatgactacatcgccaggcggcatccacaacgcgcacaatgtgtgactgattttatgagtaccgtgatgtctgggctttctgcgaaggcacgagaggggcactctatagaacaactctgtgcaacagctgcaatggcgggggaagcgataaaaactattcttgaggagtgatgcgggccttgacccgaaaggcgggaaagcgcctgccgataagttgtgataagacaataattcacgcgttaaggctagcggaattgattatcttttcgtataacgatagaaatgaaacgttgttttaattaaggagtggaaaagatgatcatcggaaatattcataatcttcagccgtggctaccccaggagttacgccaggcgattgagcatatcaaagcacacgttacggcagaaacgccaaagggcaagcacgatatcgaaggcaatcgactgttttatcttatctcggaagatatgaccgagccgtacgaagctcgccgtgcggagtaccatgcccgctatcttgacattcagattgtgttaaaaggtcaggaaggcatgaccttcagcacgcaacctgcaggcgcgccggataccgactggttagctgataaagacatcgcatttttgccggaaggcgttgatgagaaaacagttattctaaatgaaggtgattttgttgtgttttatccgggggaagtgcataaaccgctgtgcgcagtgggcgcgccagcccaggttcgcaaagcagtagtgaagatgctgatggcgtgatgacttttcgccgtaaataactcaaggtttacggcgagtttgtgaaaagagcgttttttgatatttttttgtgagtaaaatttgtaatgcttagacgttcttattcactcaaggagttcgtcatgagcaaaatatcagatttaaattattctcaacacattacattagccgacaattttaaacaaaaaagtgaagttttaaatacctggcgtgttggaatgaatgattttgcccgtattgccggggggcaggataacagaaggaatattctttctcctggagcatttttagagtttttggcaaagatatttaccctgggttatgtggattttagcaaacgctccaacgaagcgggtagaaatatgatggctcatattaagtcctcatcttattctaaagatactaatggcaatgaaaaaatgaagttttacatgaataatcctgtaggggaacgagcggattcacccaaggtgattatagaaatttcactttccactatcactactatggggactcgtcaaggacatacagccattatatttccacaacctgatggttcgactaaccgttatgaagggaagtcctttgaaagaaaagatgagagttcattacacctgattactaacaaggttctggcgtgttaccaaagtgaagctaacaagaaaatagcgcgtctattaaataataatcaggagttaaataatctacagaaattaaataatctacagaagttaaataatctactgaagttaaataatatacaggggttaaataatcctcaggagttaaataatccgcagaatttaaatgattctcaggagttaaataactcgcaggaattaaatagtccacaggagttaaatgatccgcaggagttaaataattctcaggacttaaataactctaaggtgagttgtacagtttcagttgattctacgattacgggtttattaaaagaaccattgaataatgcattattagcaataaggaacgaacatctgctattaatgcctcatgtatgtgatgaatcgatttcatacttactgggcgaaaaaggtatacttgaagaaatagataagctctacgcattaaatgatcacggaattgataatgacaaagtaggtaacaatgaaattaatgacatcaaagttaacctgtctcatattcttattgattccttagatgatgcaaaggttaaccttacaccggtcatcgattcgattctggagactttttcaaaatccccatatattaatgatgtaagaatactggattggtgttttaataaaagcatgcaatattttgatgatactaaaaagataaagcatgcatgctccgtaataaatcatattaatcttcgcagcgatcagtctaaaatagctgagacattatttttcaatctcgataaagaaccctataaaaatagccctgaattacaggggttgatttggaataagttggttgtatatgtcaatgaatttaacttaagtaatcgagaaaaaacaaatttaatacaaaggctatttgataatgttgagtctatatttaatgaagtacctgtcagcattttagtgaatgatatttttatgaatgatttctttatgaaaaatcctgagatgattaattggtacttccctcagttacttaagagttatgagggtgaaaagatttattttgataatttaaaatatgatttaaatgataatgataaggaatctaataaagaaattttgaagaatcaaccagataatgttatcaaagaaaaactgaataatgaatacaaacttagatttagaatgatgcaaactatcttgcaatcgagagttaatgtattaccatatattaatgaacagcgtttaaataaactaaatccaccggaaaatttacgtatagcaatagaacactttgggtggaagaatagacctatcactgcataaaataatgtgatgccgggatggtttgtatttcccggcatctttatagcgatagcaattatttactgagcgtcgcgaccatcaccgctttgatagtatgcatacggttttccgcctgatcaaaaacaatgctggcggcagattcgaagacctcatcagtgacttccataccgccatgtaggccaaattcttccgccattttcttgccaagcgtcgtttggtcgtcatgaaacgcgggcaggcagtggaggaatttgacctccgggttaccggtcaactgcatcatcttgctgttcacctgatattcacgcagcaatgcaatccgttccgcccatttctcttttgcttcccccatcgacacccacacatcggtatagataaagtcagcaccttcaactcccttcgcgacatcttcagtcagcgtaatattcccaccattttgctgtgccagggcgcggcattccgtaaccagcgcagcttccggccagcacgcttgtggcgcgaccagacgcaaatccagaccggtaagcgccgcagcttcgagcatcgaattgcccatgttgttacgcgcgtcacctgcatagaccagcgtcatttcgttgaacgctttgccgggcaaatgctcctgcatggtgagaagatccgccagcagctgcgtgggatggaactcattggtcaggccattccataccggcacgctagcgtattccgccagtgtttcgacaatctcctgaccatagccgcgatactgaataccgtcatacatgcgaccaagcacgcgggcagtgtctttaatcgactctttatgaccaatctggctgccgcttgggccgagataagtaacgcgagcaccctggtcatatgcggcaacttcgaaagagcatcgggtacgagtcgagtctttttcgaagatgagcgcgatgtttttaccagtgagtttggcttcttctttaccgcttttcttatcggctttcagcttcgcggctaactgcagcaggctgttgagttcagctggcgtgaaatcgagtaatttcaggaaatgcttatgataaaacccggacatagatccctcctgtggctaacgcctcaatgaattaaaattcaatttatatggatgattattcatttgcaagtctaaagcataaatctttgtcacaaaggtggaggcaatgtcagtggtgtgtgacaataagagtatcggcaggacattaagaggaatgagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgatatcgtgatttgctgcgacatcctcagcgagtgcgcgttgaatgccgatctgatcgatgcccaggttgaacaactgatgacgctggcagagaaatttgacgttgagtacgacggatggggcacttactttgaagatcctaacggcgaagatggcgacgatgaagattttgtcgatgaagacgatgacggagttcgccactaattaagcgtagcgcatcaggcccaggtagttcctgcaacctggtgaatttgtagcccggataaggcattcatgtcacatccggcataaacaaaacgtacgttgttaatgttcgaatgcccgcgagttgaacacgcgggcatttttttagagttcgcgcaacatccgcacttcacaatcgacatggcccgtgcagccaagcgcatagtcgatatgctcaaagcccaaatgctcataaagcgcaatggcttcctttaaaaaagcggtcgtttccagatagcagcgtttgaaacccatctctcgcgcctgctccatcgccattaaggccagtttttttgccagccctttgccgcggatagccggaagaaaatacatcttttgcagttcgcaaatatccgactcactcccggttaatggcgctatcccaccgccgccgaccacttcaccctcgtactcaacgacccaatatgcatggccaggctgactatatacttgatacagctcgtcaagattcggatcggcgacggtgtagcctttatcagcggtaagaccgtattcggcggatacctgacgaatgacgcgggcgatagcaggattatcctgcagcgtcaggcgacgcattacaggtgattgcggcgcaatgttattcatagtttaacccaataaaaataaagtaattatacatttgtttaataccactctcttcttacgtacgcaagcgacttataaagtaataaagtttttgccagcctattactgataagagtattgtaacgtggcagaacattttactgtctgtatatataagttatatcaatggattttttaattcagggaatttttatggctcaagttattaatgaaatggatgttccgtcccattcgtttgtttttcatggtacaggtgagagatattttcttatttgtgtggtgaatgtgttgttaacgattataacgctaggtatctatttaccatgggcattaatgaaatgtaagcgttatctttatgctaatatggaagttaacggacaacgattttcttatggaattaccggtgggaatgtttttgttagttgtcttttttttgtttttttctatttcgcaatcttaatgacagtgtcagcagatatgccgcttgttggttgtgttttgactttgttactgttggttttgcttatatttatggcagcaaaaggactgcgtcatcaggccttaatgaccagtctcaacggcgtaagatttagttttaattgctctatgaaagggttctggtgggtgacctttttcttgccgattttaatggccattgggatggggactgttttctttatctcgacaaagatgctacctgccaatagttcaagtagtgttattatatccatggttctgatggcaatagttggtattgtttccattggtatttttaatggtactttatatagtctggtaatgagttttctctggagtaataccagtttcggtatacatcgtttcaaggtgaaattagatactacgtattgtataaaatatgccattctcgcatttttagctttattgccttttctcgctgttgctggttatattatcttcgatcaaatattaaatgcgtatgatagttctgtatatgcaaatgatgacattgagaatttacagcaatttatggaaatgcaacgtaaaatgataatcgcgcagttaatctattattttgggattgctgttagcacaagttatttaacggtgtctttgcgaaaccattttatgagcaacctgtcactgaatgatgggcgtattcgttttcgcttaactttaacgtaccacggtatgctttatcgcatgtgtgcgttggtggtgatatccgggattacgggcggtctggcttatccactgctgaaaatatggatgattgactggcaggcaaaaaatacgtatttgctgggcgatttggatgaccttcctttaatcaataaagaagaacaaccagataaaggcttcttagccagtatttcacggggagttatgccttctttaccatttctgtaagagataaaaaaggccggagcatgctccggccttcgttttcatcactgtgttttgattacagcgcggcgataacagcctgctgttcaatcagtttcgctttcgcttccgcatagccttccagcttctcacgctctttcgcgatgaccgcttccggtgcgcgggcgacaaagccttcgttcgccagtttgttctcgatacggctgatttcaccttcaatcttcgccacttctttcgccagacgcgccagctcatcttctttgttgatgaggccagccatcgggatcagcagctctgcaccgtcgatgatcttcgtaacggaaaccggacctttgtcatcggcaggcagcacggtgatactttccagacgcgccagggtttgcaggaagccacggttttcatttacgcgacgttctgcatccgcgctgcaaccacgcagcagcagctccagcggtttgcccggcgcgatgttcatttctgcacggatgttacgtaccgcaacgatcgcctgtttcagccattcggtgtcggccagtgcggcttcatcaacctgagatgcatcgtactgcgggaacggctgcagcatgatggtgtcggcagtgataccgcaaagtactttcacacgctgccagatggtttcggtgatgaacggaatgatcggatgcgcgaggcgcagcagaccttccagtacagtcaccagcgtatggcgagtaccgcgcagttctgcttcggtgccaccgttcattaccggcttggtcagctcgagataccagtcacagaactggttccaggtgaactcatacagaatgcctgcggcgatatcgaagcggaagctgtccagcgcttcgcggtacgctttgatggtctggttgaactccgccagaatccagcggtccgccagcgacagcgtcatttcgccgccgttgaagccgcaatcctgaccttctgtgttcatcagcacaaagcggctggcgttccacagcttgttacagaagttacggtaaccttccagacgcttcatatcccagttgatgtcacgaccggtagacgccagcgccgccagggtgaagcgcagcgcgtcagtaccgtgcggctcaataccgttcgggaactgcttctcggtgcgcttacggattttgtccgccagctgcggctgcatcatattgccggtacgtttttccagcagttctggcagcgaaataccgtcaaccatatccagtgggtcgataacgttacccttggatttggacatcttctggccttcgtcatcacgaatcaggccggtcatgtaaacggtgtggaacggcacctgcggtttgccattttcatctttgatgaagtgcatggtcatcatgatcatgcgggcaatccagaagaaaatgatgtcgaaaccagataccatcacgctggttgggtggaactgacgcagggcgtcggtattttccggccagccaagggtagagaaggtccacagcgcagaagagaaccaggtatcgagaacgtcttcgtcctgacgcaggacaacatcagcaccgaggttattttctttacgcacttcgtcttcgttgcggccaacataaacgttacccgcttcgtcataccatgccgggatacggtgaccccaccacaactgacgagagatacaccagtcctgaatatcgcgcatccaggagaagtacatgttttcgtactgcttcggtacgaactgaatgtcgccgttctcaaccgcttcaaccgccggtttcgccaggacatcggcacgcacgtaccactggtcggtcagcattggttcgataactacgccgccacggtcgccgtaaggaacggtcaggtcgtgcggtttaatttcttccagcaggccaagcgcgtcaactgcggcaacgactgctttacgtgcagcaaaacgctccagtttctggaactctgcagggatttcgctggaataaacgtcagattcgttacctttggtatcgaacacctgggcgctttcacggatatcgccgtcaaaggtcaggatgttgatcatcggcagggcgtgacgtttacccacttcatagtcgttaaagtcgtgcgccggagtgattttcacgcagccggtgcctttttccatgtcggcgtgttcgtcgccaacgatcggaatacgacggttaaccagcggcagaatgacatatttgccaatcagatctttgtaacgcggatcttccgggttaacggctacgccagtatcgcccagcagggtttctggacgggtagtcgcgaccaccagataatctttaccgtctgcggttttcgcaccgtcagccagcggatagcggatgtgccacatcgaacctttcgattcgcggttttcgacttccaggtcagagatagcggtgcgcagtttcggatcccagtttaccaggcgtttgccacggtaaatcaggtcttctttatacagacgaacgaaaacttctttcaccgcattggacaggccttcgtccatggtgaagcgttcacgctcccagtcgacggagttgccgagacggcgcatctgacgggtaatggtgccgccagattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgccggctgctgctacgcttttgcggccaggcgatctccaccggtgcaccgccgcgcggtccttctcccgctaaattatgcggaacaaagctttctgccggacgcgcccacagggcttcatccagccggtaagcctgcttttcatcttcacaggcgatgagcacgcgcttaccgctgcgccaacgttctgcggcaatttcacacaccagttgctcaacggcgcttaagccatcgacggtggtgtcattgtccagaaggtagaacgtcgcgtttttcataaatggggcttcttgtggtggatttaaatacgcatcaggtatacaccgcagcgcctgatgcgacgctgttgtgtcttatcaggcctacgagttcagtgctgtgtaggtcggataaggcgttcacgccgcatccggcaataacagccttgcctgacgcaattactcttcgccgttaaacccagcgcggtttaacaggaactgtgccagcaacgctaccggacgaccggtggcgccttttgctttaccagaacgccaggcggtaccggcgatatccaggtgcgcccagttgtacttacgggtaaagcgtgacaggaagcaacctgcggtaatcgccccaccaggacgaccgccaatgttcgccatatcggcaaaattggactccagttgttcctgatactcgtcacccagcggtaagcgccatgcgcggtcaccggattgttcagacgcggcaatcagttcatgggccagcggattatggttcgccatcagaccagtaatatgatgacccagcgcgatcacgcaggcaccggtcagcgtcgccacgtcaatcaccgcttccggctcaaaacgctcaacgtaagttaacacgtcgcacagtaccaggcggccttcagcgtcggtgttcagcacttcaacggtttgaccggacatggtggttaacacatcgcccggacgataggctcgtccgccaggcatgttttcgcagcctgccaacacgccgataacgttaatcggcagttgtagctccgcgaccatccgcatcacgccgtaaaccgctgccgcaccgcacatatcgtacttcatctcatccatgccttctgaaggcttgatcgagataccgccggagtcgaaggttaaacctttacccaccagcacgattgggcgtgcatcttccgacgcgttgcctttgtactcaatcaccgacatcagcgattcgttttgcgaaccctgaccgaccgccagataggaatgcatccccagctctttcatctgctgttcgccgataacgcgggtgatgacattcttgctgtagctgtcagccagctggcgcgcttgtgaagcgaggtaagcggcgttacagatattcggcggcatattgccgagatcttttgctgctttaatcccggcggcaatcgccagaccgtgctggatcgcgcgctcaccgctggtcagttcacggcgggtcggcacgttgaacaccatcttacgcagcggacgacgcggttcgctcttgttcgttttcagctgatcgaaactgtagagcgtctcttttgccgtctcgacagcctgacgcactttccagtagttgttacggcctttaacgtgcagctcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggaacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaatctggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggcctgagcaaagcggttctggtgaaagcggcaatgatccttgcggtattcacggcaatcgtagcggcggttaacgtgatgtgggcgggaccgtggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgtccttctgtggtggtggccgattccggacatttaacccagctgcgcgacggctcccaggtcgtcactctcaaccagggaacgcgcttcgaaggcactgcattgttacgtgatttccgcattacggacttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtattcaccgtgtttatgatggcacttatggtcgtaccgctgagcgtggttaacccacgtcagggacgcgtactgtcgatgctgccagccatgctgctgtatctacttttcttcctgatccagacctccctgaaatcgaacggcggtaaaggtaagctggacccgacgctgtggatgtggaccgttaacctgatttatctggctttagcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacactgttcatgctggtgtcgctgtcgggcattatcaagtttgtcgatcagctgaaaaaagccgggcaggggagttacgacgcgttaggcgcaggaatgtataccttgctgagcgtgccgaaagatgtgcagatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggcgaatgggtcgcgccgcagggcgagcagatggcgcgtaactaccgtgcgcaggcgatgtacggcggctcgttgctctctacccagcaaggcttatgggcgaaagatggcaacaacttcgtctacattgagcgggttaaaggtgacgaagagttaggtggcatcagcatttatgcctttaacgagaatcgtcgtctgcaatccgtacgctatgccgctactgcgaagtttgacccggaacataaagtctggcgtctgtcgcaggttgatgaatctgatctgaccaatccgaaacagattaccggttcgcagacggtgagcggcacctggaaaaccaacctcacgccggacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatctgtggcggtgatgatgctgatggcgctgtcgttcatctttggcccactgcgtagcgtaccgatgggcgtgcgtgtggtcaccggtatcagtttcggttttgtcttctacgtactggaccagatcttcggcccgctgacgttggtttatggcatcccgccgatcatcggcgcactgttgccaagcgccagcttcttcttaatcagcctgtggctgttaatgagaaaatcgtaaccgaatgaacgaataaagggagcgaaagctccctttattattgttagcaaagtgtgcttcgttcattcctgaaaaataattaaaattcaatatattgcagtggggtgggcatgataagacgcgccagcgtcgcatcaggcaaagacaaatctcgcctgacttaccttcttctcccccccagcaaactccccaacatcccgcgtacaatctgattcgtcacttggcgagcggcgcttttggccattgtttgcaccacaccatctttcttcccgccgcgtggtccggtagtgccgaacaaaatatccttcaatccaccaagaatgccgtcatccaccgctacctctttccctttcgcgggaggattattttgctgctcggtactggcctgaaagcctttttgcaacatctcataggcggattcccggtccacctcatcctcatatttgccatacaccggagagtgattaatcaagccattacgctcatcttccgtcaccggccccatccgcgaacaaggcgcgatcaccatcgcacgctccaccacagaagggcttcctttcgcatccagaaaagagatcaacgcctcgccggtgcccagttcctgaatcgccttttcggtatcaaacgccggattggcccgcatggtttgcgccgctgccttcactgctttctgatcttttggcgtaaaagcccgcaaagcatgttgaacgcgattaccgagctgcccgagcacattatccggaatatcagacgggttttgcgaaacgaaccagacgcccacgccttttgagcgaataagccttatcacctgctcaatcttatccagcagtacctgcggggcatcgttaaacagcagatgtgcctcgtcgaagaaaaacaccagttttggtttctccagatcgcccgcttccggcaattgttcatacaactctgaaagcatccacagcaggctggcggcgtacagtttcggcatctgataaagtttctcggcgctgaggatattgataacgcctttaccgttggcatcggtgcgcatccagtctttgatatccagcatcggctcaccaaagaagtgtgctgcgccttgctgttccagcgacaacagcccgcgctggatggcaccaaccgatgcgctactgatattaccgtactgattctggaaggatttggcgttatcgccgatgtactgggtaattgcccgcagatctttaaagtcgagcagtaacagcccctgatcgtcagcaatgcggaagatgatattcagcacgccagattgcacatcgttgagattcaacagtcgtgccagcaacagcggccccagatccgaaaccgtcgcccgcaccggatggcctttctcgccaaagatatcccacaccaccaccggattggcatgcggttgccagtcattgacgccgatatttttaagccttgcgagcagtttttccgacaccgttcctgcctgcgcgacgccggtcagatcgcctttcacatcagccataaacaccggcacgccgatttccgacaatgactccgccagtttttgcagcgtaacggttttacccgtccccgttgcgccggtaatcagcccatgacggttagccattcccggcagtaaaaacagttctgtgtccggcgtgcgggcaattaacaggggttcactcatgagatatcctccagtttcctgcctggagtataggcaacgtccggcaaagagaatacgtgtaatgaagagaaaataacctaaagcgtgttgccgtgataaatctgatacccgaggtcaacagtgttgtggttgtgatcgttatttttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgtgcctgactcgcttctccagcatggtacacaccatgtcaaaagcggcctgccgattatcaaaaccgacctccatatccagccgttctccctgtacatccatcaattccacgaccggaatggtggctgaacgcagaaatttcaccgtcctgatggtgtgatatttttccgaaagtataatcccgtcaatgttataagagagcaggttaatcaccgactcttcttcggaatcgcgatcgtaattgtaattagcaataagggtctgataattatgctcagaggtgacggattctattcccgcgagaatgtcagcgaagagttgattttgaaatgacggaatcaagataccgagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacggcgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccggttgccagtaccattaaagcgggatcggcatgggtaacgttgataatcggcaacaccacacccgcggtggtaatggccgcgacggtggcagagcccagagcgatacgcaacagcgccgcaacagtccagcacatcaataacggcgaaagtgtagttccggtcattaagtgtgaaatatagtgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcacggcagcgaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccattggtacgccaacatacaacaggggtaatcctgatgatgctacgatggtaaataccaacggcaacagcaggacaaaacccacttcaaaaaacatggcgaggcccacaaccagaccggtgatcactagcgcccattgcacgcgttttttaccaaaagtagcaatcagcgtagtggcgatacgttgtgccgcacccgtatcagaaatcagcttgcctaacatggccccgaaaccgaggatcattgccagcccgccgagcgtgctgccgataccattttgtatagagtgcaggacggcctgtgcatccatcccttcggcaaatccgacgacggcagctaccagaacgagggcaataaagccgttaactttaaagccgatcatcaggataagaagcagcgcgacgcctgccgcaataatgattaatggcatagtctttatctcttattagtgccagaaaagcagcgctttcgcgctgcacgtaggggggctgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgccagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgataccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtcagtgaagggatattcagcactcagtaaaggcagtggattgataacgccattcgccagccatgacactgcggtattaaattcgctggtaaaacggaaagagcctctgagtgaaatctccttaccaatcaacgtcatcattgggaattctgccatcgcgcctcccatacctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcagcacagacaatttccgcggcccccagtgttttcactgcactgacaatcaggcagccaatgggtccaacaccggaaataaatactcgcttgccctgtaactcgccggcctgatgtgcggcatgaatcgcgacggctaaaggttcggcaaaagccataaccttttcgtcagctttggccggataagggacacattgcgacgtttcgaccattttataacgggtaaaaccaccatcaacatgagggaaatacatggcactgccaaaaaaacgcatatctgtacactgattctcgttatgttcaatgcagtatttgcagtgaccgcacggtttagacggattaatggctaccgtttgcccttcatgtaattctgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaactgtcattatttgtgatgaagatcacgtcagaaaattgttacattactatgttacgcataacgtgatgtgccttgtaattcttatcagtagaaataaaaaaacgtgaaattattatgccgccaggcgtagtatcgcagcaggtaagatgattcaggagattttaaatggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagcagatgaacaggatattgtgcgcattgatatcaaccatgatattgccaatgtcaccgaacaatgtcggcaggctgtgctggcgatacgacaaaacagaatatgtgcgaaagagggcagcgcctcagatcagcgctgcgaatgattttcaaaaatcggctttcaacaccacgcggtaacgcgccttaccgtcgcgcacatgctggatggcgtcgttaattttcgacatcgggaacagttcggtggtcggcgcaaccttgctgcgggcggcaaaacgcatcagcttacgcagctcataaggcgtgccggtagcagaaccagagacgctgcgatcgcccgcaattaacgtaaaggccggaacagacagcggcgtgagaaccgcaccgaccgtatggaaattaccgccataggtcagcgcctcaaaatagggctgccagtcgaggctgacgttgacggtgttgataatgagatcaaactgccccgccagtgctttcagtgcctgcggatcgcggctattcaccactttatcggcacccatcgccagcacttcctgctctttcgccggattagaactaaaggctgtcacctcgcatcccattgcgtgcagaagttttatagcgatatgccccagcccgccaataccaattaccccaacgcggctggtagcagtgatatggtgcatcaacagtggtttaaagaccgtgataccgccgcacaacagcggcccggcggactcgatatcaatattttctggcagtggaatcacccattgccagtccgcacgcaacttctcggcaaagccaccgcgattcataatcgtcggcaccgcaccttgctcgcagttgatctgattaccgctaatacaggcgtcgcagtgaccacagctacgcgccgtccagccaatcccgacacgctgaccgacctgcaaacctttatcctgcgcggcgctcccgagtgccaccacgcgcccaatcacctcatgcccggcaaccagcggatattgtgaaaatccccattcgttatcgatcatcgacagatcggaatggcagatcccgcagtaatccacctgcacttcaacatcttgtggcctcagctcaccgggatcgtactcataaacttccagttcgccgcccgcttcttttgcggcatagctttttatcatcgacattttttggtccttctctggtgttgtttgggaagtgtagagcatggcagggcggggtgcctggagtgtgacaaaggttacacatcgctgtatgcaatgctgaaaatttcagcacttagcgaggtgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccaaaagtatgtaaatagacctcaactgaggtctttttttatgcctgaaatccagtgtttatctatctttcccgctatattaactctctcaaggtcaaccgatatcaacgtacatctaccaacatatgttggtacagatgatggtatttccggttcgataatgcttgtaccaacagggagggaatacgatggcattaacagatatcaaagtcagagcagccaagccaacggataagcaatattagctgactgatggtggcggtatgcatctgcttgtccatccaaatggttctaagtactggcgtttgcagtaccgttatgagggaaagcaaaaaatgctggcacttggggtttatcctgaaatcacactagcggatgccagagtacgtcgtgacgaggcgcgtaagctgcttgcgaatggcgtcgatccgggagacaaaaagaaaaatgataaggttgaacagagtaaagcacgaacctttaaagaagtcgcgattgagtggcatggcaccaataaaaagtggtctgaagatcacgcccatcgtgtgctaaaaagtcttgaagataatctttttgcagcgcttggtgaacgtaatatcgctgagttaaaaactcgagatttattagcacctattaaggccgtagaaatgtctggacgtcttgaagtggccgctcgtcttcagcagcgcactacagccatcatgcgctatgcagtgcaaagtgggttaattgattataacccggcacaagagatggctggggcggttgcttcctgtaatcgacaacatcgtcccgcgcttgaattaaagcgcatccctgagttgcttacaaaaatagatagctatactggtaggccgctaacccgatgggcgatagaactcactttgctgatctttattcggtccagtgagctgcgttttgctcgttggtcagagatcgatttcgaagcgtctatatggactatcccaccggagcgggagcctattcctggagtgaaacattcccatagaggctcaaaaatgcgtacaacgcatctagtgcctctttcaacgcaagctcttgcaattttaaagcagataaaacagttttatggggcccatgacttgatatttattggtgatcacgattcgcacaaacccatgagtgagaatacggtaaatagtgcgttacgggtcatggggtatgatacaaaagtagaggtttgtggtcatggctttcgaacaatggcctgtagttcattggtcgaatcaggtctgtggtctcgtgatgctgttgaacgtcagatgagccacatggcgcgaaattcagtgagggccgcgtatatccataaagcagagcatctggaagaacggcgattgatgctacagtggtgggccgattttctggatgtaaacagagaaaggtttatcagtccatttgaatatgcaaagattaataatccattaaaacagtaatcatcccgggcaaatgcccgggaattattctaggattattttctttgttaaaaaagacaaacggtattaactgatgtatttactatttaccgctccctgcaggggggattatcagaatccgcggttattcattatttatatacattcaataaaaaagtaacctcataaaaaatcctgtactcacagggtgatgcgggataactgacgtaaggagtgctgcagggatttgatggtcccttgtagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaccttgtgctgatatgaatacggatattttatacagaatacttttcagtacaagcgactgtattacagtctgccatatatgattacctgtgatcaggaagaataagtggctgaggtttcaaactgtctgccggtatattcctctctcccttaaaaaccataacaggttagttatcttcgtctgtcagcggattgaatggcggtatattttcagtacaaataccggtcatccactgaaaaatacctgcgaaatgacgggcactgatttttctactgacgggctgatgagacgttatgtcactggcggtaataatcagtggcacactgtagcctccctgcacatgaccataatgatgaacaggattggcactgtcgctgaccgacagcccaaggccagaaaagtaaagcatggcgaaatgacgtgagtaccggcgaaggataccatcaagctggccaagaaagttatccagtttactgatgctggcgaggtaacaggcaatttttcggggatactgctccaggtaattattcggctaggagttaaggctgtcacacggatttggatgagaacccatcatgtgcaggaaaattatcttcggagaggatgtatccgccagcgcacgttctgtttcctgtaacaacagtttgtcatctgttttacgggaagcgaagctgcctttcttgaggaaagtggcatgctccgcatcagaagcaataacagagatgcgtgtgtcatgctcccccagttttccttgattggatatccaccatgtgctgtatcctgcttttgctgccagcgccaccacattgttgccggaatcagggttctgctcatagtcataaatcagtgtccggctcagggaagacactgtactggaggctgtcgaggtataatcgtcaataaataaaccgggtgccgtattcagccacggtgtggttggtacgggatagtcatacactgacatataatccctgcgcacactctcaccagtgacaataacaatcgtatcatataacggtgctcccggctggattttccagttgtcagccccgtgctactcagttgttcataacgctgcatttcacgtaatgtgtcagttgtccccacaactgttcctttaaccatccgcaatggccaacggtttacagagcataatacgaatagccgtagagccagccagttacggtggtcgcgatggtgtgtccgccagaaaatcaccacgaataccagaatcgcggcactgaccagaaaatgataaacaggaaacacggggcggttcactttgctttctcctgtagtgttttctgtaggttctgaaccggttctagcggggttgtgaggctgatggcaatcgccgggctcttcctgcatgttacactggtactgcaagagggggccttcgctcctctgacattactcagtattttcactactacaccccatctgccatccataacaaccgattcaccccctcgcgaggcgttgttgcccgtcacccggacagacaccgttatggacttctcttgttgcacgatcgatcaattgttatgcatgctgacaccacaaccccggtgggtatgaccgatgcctttctcactctcttcccggtcatcgtcggccttccccgttattgtggcgtgtcagcaccctcgacggcatttcgatggctgctcagtgttcactcacgttacggcccgcataacccgttgacttcctgaagaagtcgtttcagggagagattcagcccttttgttacctcctggaccgcttcttgtccttccagtcggagcgagagttagccggggcggactttcaccgacggaaagatcgtgcatttcaaggcacacacaacaatatctgcgagcgtgctatccgtccggtcgttatgggacgaaaggcctggttgttcgctggttcactggtggccgggaaccgcgcggcacagataatgagccttctgggaaccgcagtctggagccacatgcttggctgacggacgtcctgacgcgtctgccggagtggccggaggagaggttggctgagttactgcctcttgagggctttaccttcttcgggtaagtgatacctgccgtcaggtgtttgtgcaccgggccataacctgcagttgggaattgaacgcctgacaacaggaaatgagctagagcagtaaacacgcgggctgacaatgggtcagaatatgagttagcccggcgttattcctggggtcagtacttcagatctagcctccggtaccagactagctagcccctacgcaaccaaataaatcaaccatcgtcagagtgcaatcgttcatatacactgtcggtgatgcgctaaaaaatgcgttaatgttgagttcctcgaacccttaccaattaagggacatagccagatacgcaactggctgatgcaagcagtctaatgtctttagatccgctggcctgcgggcatgacaatgtcaaacagtcaaagattgtggcgttgacggtcagtcttggggacaaaaaagctcagtattctcgttggcaaccagataatttaacagttgatgctgaaacgaaataggcatcttggttctgtaatgccagtcagttaagcaactgactggctctttttcggggctgtggggtatttccagggcctctcctttaccactctcgggaaggccctttcccttcttgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctccgttgcatcgtctgttttatctccctgtatcccagttcgatttcccagcgatgactgtacagatcccccatttctcctccggggaagcgcatggcgtccgtcatcgacgtcagcagatggcagacttttcctttgcgcgtcacggtcagcaggcgggcagtcacttcatttcccagtcccggccacttttttcgtgcctgcgggctggttttcagcttcaccagatgatcgcctttacccagttttctgatctcttcatattgcgctccctttctgagaggtatcatccagtggcggtgttctcccgccaggctccaggcatttaacagtcccagtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggataccagatcaagagcctgtccaatgtgcataaaaaaatccggaaacaagtgagcgtttccggattcttacacagccactggatcggtcaactgatccttaactgatcggcattaatcttggttctggtgtttgtaacaaactatcagctacaaaaatatgctcaatttgtgacatcagtaacaaaacgcgttttgttatgtggattgcttgttttttgatctggtataacaggtataaaggtatacagaaaagcaaagaaatactgcaaaggaaaacagctataacgtaagctaaagtaataacctctcagtctttcctcatttgacgaagggagttttattcaacctgaacggactacgaaaatgagcacaatgaataagtcaatttttgaagcagggttgaactgtgccagtggtggaatatctggcgaacattgttttttgttggtgacccaaaactgtaggtgggtatcagttttatctttcatagagtgaaatatgttaagaagaaatggaggaaaagattgtactgattaggtattgataacaatcaatagtactggcgtatttgaagacaatataattatttctggatattgttgaggctccctaatatttactttaagggctatattagaataacacaggaaacaaatatggcaacagcatggtataaacaagttaatccaccacaacggaaagctcttttttccgcatggcttggatatgtatttgatggctttgattttatgatgatattttacattcttcatattataaaagcagatcttggcattacggatattcaggctactttaatagggacagtggccttcatagccagacctattggaggtggtttttttggtgccatggctgataaatatggtcgtaagccaatgatgatgtgggcaattttcatttactcagtcggaacaggccttagcggtattgctacaaacttatatatgctcgcagtttgccgttttattgttggcttagggatgtctggtgaatatgcatgtgcttcaacttatgcggtagaaagttggcctaaaaatcttcaatctaaagctagtgcttttttggtaagtggtttttctgttggaaatattattgcggcacaaataatccctcagtttgctgaagtatatggatggagaaactctttttttataggcctgttaccagttttactagttctttggatcagaaaaagtgctccagaaagtcaggagtggattgaagataaatataaggataaatcaacatttttgtctgtcttcagaaaaccacatctttcaatctctatgatcgttttcctcgtctgtttttgtctatttggtgcaaactggccgataaacggactacttccttcctacctggcagataatggagttaatacagtggtcatttcaactctgatgacaatagcaggtttaggaacactgacaggtacaatattttttggttttgttggtgataagattggtgtaaaaaaagcctttgtagtcggtctaataacttcatttattttcctttgtcctcttttttttatttctgtgaaaaactcttctcttataggattatgtctctttggattaatgtttacaaatttaggtattgcagggttggttccaaaatttatatatgattactttccaacaaaattaagaggattagggaccggtcttatttataacttaggggcaactggaggaatggccgcacctgtattagctacatacatttcaggatattatggcttaggtgtttcattattcattgttacggttgcattctctgccttattaattttgttagttggttttgatattccaggtaaaatttataaactatccgtggctaaatgattggaggctttatgattaattatggcgttgttggtgttggatactttggcgctgaattagctcgttttatgaatatgcatgataatgcaaaaattacatgtgtatacgatcctgaaaatggagaaaatattgcccgtgaattgcagtgtatcaatatgtcaagcttggatgctttagtctcaagtaaattagtcgattgcgtgatcgtagccaccccaaattatctgcataaagaaccagtaattaaagcagcaaagaataagaagcatgttttttgtgaaaaaccaattgcattaagttatgaagattgtgtggatatggtcaaagcgtgtaaagaagctggtgtgacctttatggccgggcatattatgaattttttcaatggggttcaatatgcacggaagttaattaaagaaggtgttatcggcgaaatattatcatgtcatactaagagaaatggctgggaaaacaaacaagagagactttcctggaaaaagatgaaagaacaatctggtggacatctatatcatcatatacatgagttagattgtgttcagcatttacttggagaaataccagagacggttactatgattggtggaaatttggcccattctggtccaggatttggcaatgaagatgatatgttatttatgaccttggaattcccgtcaggaaaactagcaaccttagagtgggggagtgcatttaactggccggaacattatgtcatcatcaatggaactaaaggctctattaaaattgatatgcaagaaacagcagggtcacttaggattggcggtcagacaaagcattttttggtccatgaaacacaagaagaagatgatgatcgtcggaaaggcaatatgacctcagaaatggatggcgctatagcatatggtcatccaggaaaaaaaacaccattatggcttgccagtttaataagaaaggagacgttattcctccataatatcctctgtggtgcaaaacctgaagaagattatattgaccttctcaatggtgaggcggccatgtcggcgattgctactgctgatgctgccactctttcaagatcgcaggacaggaaagtgaaaatcagtgagatcattaaacatacatcagtaatgtaaaaactatacgcctcttgatttaattcaggaggccttttatgtatgatcaagaattttatcttcgataatctcataattttagcagtgccatttatgataaaaacatcccttaaaaccaatctaatctttttcttcctctgtgtatttgttccccatatggcgtcataatttacgctacgtaatacgggatagttacgatacgcagcgatagcgctaagttttagttaaaatcccccatcagcgggatatggggatctctgggaggttcaggttttagcatcgcgactttaatacgacagacgctggtgacgatgatgccaagtagtgactcttccgaataaggttcccactgaccaattggcgcgcgcttcgcaataaaatctcccttcgcccagtattgggaaaagtagatacattcaaactgtgtacgctgtttcgtctcacagttcacgacattgctggccgatgagctgaccattgggcctatccgggctgtcccgatggatattacgccgaagtatgtgggaattgccagcggattgatgaacgccggttccgctgtcgccgacattatttcacctatcgcctttggcattattatcgacaaaacaggcaactggagtttaccattctacggttccgtcgcattgcttgttattggtatattcctgacgttcttcatgcgtccagataagtcattgtaaaagtcgaatcagggctgaagtggcacactgaatttggccacctgaacagaggtgatatgctcacctcagaacaacacaggtgctccaatgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacggattgaaatggagaatgaaatattaaaaaggctactgtagattcaatctgtcaatgcaacacccctttcaattatctctttcggtgttttgaacttcagtgtctttctcggtctgttgtttagctgagcagcaaccagatctagttcatgttgagtatattgggcaagacatgtctttttaggaaagtactgccgaattagcccatttgtgttctcatttgttccccgctgccaaggactctgaggatcgcagaagtaaactttaacgccggtgctgacagtaaattctagatgtctggccagttccattcctctgtcccatgtcagtgattttctgagttctgacggtaaactcaggaatttgtcggtaagagcctgatttactgagacagaatctttgcccctgagtctaaggatgatcgtataacgtgattttcggtctacaagtgtggctatatgagagttttttgtacctgagactaaatcgccctcccaatgccctagagagcgtctgttatcgatatttcgggaacgttcgtgaattggtgttccgttcactatgttaatcgtacctctttcgcctttgcgggtatgacgcctgccatggcgaaggctatgcgaccgtcgcagatgctgtatattcaggtggtgtagcgcttcacggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttcaaaaacagaggctttttcctctgctgtaaatgttcgtctcattcaaaaaacctccgcaaccccatgttttcacataactgttgcgttgaccaattgaatctacagttgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactttttagagtaacgttgggtttttctgctcattattagctccttctgatgccattctatttcaggaaggagtgtccgttaaactcaggctacctcaggaaaaaccgtcctgaaaaaccagacggcagacgggctgtattacgcagtcaggtacttgagctacatggcatcagccacggttcggccggagcaagaagcatcgccacaatggcaacccggagaggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggcttaccatgaaagcactggaaatggcatgggaaacccgtggtaagcccgtcggggtgatgttccaagcgatcaaggcagtcattatacgagcaggcagttccggcagttactgtggcgataccggatcaggcagagtatgagtcggcgtggaaactgctgggataacagcccaatggagcgcttcttcaggagtctgaagaacgaatgggtgccagcgacgggctatgtaagcttcagcgatgcagctcacgcaataacggactatatcgttggatattacagcgcactaagaccgcacgaatataatggtgggttaccaccaaacgaatcagaaaaccgatactggaaaaactctaacgcggaggccagttttagttgaccacaacagactacctgaagggagccgcggtcgcctggcagttgcagtagcaggagatcatccagccgcagtacaggtcacgatgactctggttaatgataccggctttgaccccgtattttccggctctatcgctgaatcatggcgtcagcagccgtgcacaccatcctattgttgtgactgggaggctgccaccatgcttcgcgctttccctctggcgaaaaagggagaaggacgggcccgtctgccttcactttatgccagcttcggtaagctgggtgagacaccgactcatgaagatatcattgataacaatcgatccatcaactggcctgtataacgtggctgccggtgattaagaaagctgcacctacctaagtagtagcaaacgcacactttttagaaaaatcgatggtcagaaactggattagcaattccgttccatggttgcttttgatttacgttggcgtctgatcattgatttatcctcaaaagcccaacctcattggtaatgaaccagctccgtgaatgtccgctctggcacagagcgaaattttttgatctcccccctgaaatctaaacttagtcatgtcacgtttttgggtttctaaaattttaacttcgcgtttttcgttgccgtaagggttatacagaaatgtccgttaagcagagttcaaaattgattgccgtgatcacgactggtttgaaagccgcgcccaagcctgtacagctctggtttgcgttgattatgaacctgtcagcctaaagcaagcggatggacgatgagtattggtaatctttcagagtccggaaaagttcagccccagtctgaacaggcttgctggcgccagtccagtttcattcagtcgtggtttggttcttacggcctgtgcaatctacctcattaggcacatcggcctgccagataccggctcggggtgtatttccgcttccacgctgaatactgttctcagcaatcctggggtcatcacctcttctggtgtgccttgcgccataacatgtccgtttgccattaccaccagttgatcgcagtaccggctagcctgattaaggtcgtgcagcacagcgaccaccgttttcccctgagtccggagttcgcccatcaaccgcatcaggtccacctggtgattgatatcaagataggtggttggctcatcaagtaatacaacgggcgtattctgggccaggaccattgccagaaatgcgcgctggcgctgaccgccggaaagctcggttaaccgacgaacggcaagatgattgatccgggtctggttcatggcgacattaactcgtgcattgtcttcagcggagagacgcccccagagtgacagccagggattacgaccatacgaaaccagctcctggactgtgatcccctctggcgttaaatggtgctgaggcagcagcgaaagcctgcgggccaactggcgcgatgagagcatatttatgggattatcgccgagaaatacggtgccagactgcggcattaaaagccgcgaaaaacagtttaacagcgtcgatttcccgcaaccgttaggaccgatcagggcggtgatcttccccgttggcagtgagagtgaaacgtcgttaagtaccttgtctgtcccgtaactgaccgtcagattttcagttcgtaaagtcatttatcgcattctcacaagcaaccagacaaaccacggcgcaccgataatggcggtcagcacgccaaccgggagctccagtgggggatgaataattctcgccagcagatcggcaaccaccaacagcaacgcacctgtcagggccgaaacaggcagcagtctgcggtgacgtccaccggtgatgctacgcatcatatgcggcaccacgagaccaataaagctaatcgggccgcaggcggccacgccggtagatgtcatggcgacagctagtaacaaagcccagaatcgggtatggggcaccgacacaccgagcgtggtggcgcgcgcatcgccgagtgcaaggaggtcgagatcgcggcaaaaactcaggctcagcggcagaaataaaatcatcagcgggatggcaatcttcacaaagctccagtcacggccccataagctgccggtcagccacagcagggcgttgttcacatcctgcgggcgcgagagcatcagataatccgtcaggctggcccagcatgcagaaagcgccacgccggtgagcgccagcttcatcggctggtgggtctttgccagcatcttcagcaatatcaaccccgccatgccgcccgcaaaggccagcagcggcagcaccatcacgggcagtgacggcataagaagtagagcccccacagaggccaggctggcggcatggttaacaccgagaatatccggtgatgccagagggttgcgcacaatcccctgtatcagcacgcccgccacggcgagggctgcaccgacaaacagtgccagcagcaagcgcggcagtcggtactccatcaatacataataatgctcgtgtccggcctgccagtcggtcagcagcgcgcgccacggcacggggatcactcccatatggagtgataacagcgcacagcccgccagggcaagggtgatgaaaataaccagcgcaattttcatcctcgcctcctcacaagccagacaaagcaagggctgccaatcagcgccagcactgcgcctgcgggcagatctccggggaaggccagcgcgcgtgcgagtacatctgccagcagcatcagcgtggcccccagcagcatgctcactggcagtacgttgcgctgatcgaagcctgcccagaagcgcgccagatgtggcaccagcagaccgataaacgccaccggacctgctacgctgacgcacgcaccaaccagaagcagcactaacatattgatgaccaaacgtagcctcgtcaggttcactcccagcgtatgggcggtgctgtcgctgaggttgagcaggttcagttgattcgccagcagcaacacgacagggactgcagtgaccaccaccggcaagagctgccagacatcctgccagcgggcgtgggacactccgcctgccagccagtaaaagatgccgtaagcatgatcttcggccagcagcagggtgatgcgggtaaggcccatacaaaaggccgacagcgcgatacccgcgaggatcagtttgtttctgtcatgggtatgacgaaatccgcctcctgcggtcatgaccagcagccagctcacgccgcccccgcatgccgcgatgaatgacagagaatagcctgcaatcggcgtcggactcagcgcgctggtaagcgccatagccagcgccgcgccgctgttaatgccgagcagtgaaggagaggccattgggttgtgggtcagggtttgcagcagcgtgcccgcgagcgccaggcttgcgccgatcagaacggcgaccaggcttcgtggcaaacgaaggttttgcaccagcgcttctggtagcgttggcgtgtgtccaggcagcagggcgcgggttgcatctgctccggaaacaggaatggccgagtagcaaaacagactcagccagaaaataataataagtgctgcaacgggaagcccccacagcagcaccgggtgttttatcgcggtcatttcacaacggtaagcggctgatggtggaagatttttaccgtgtcagcggcaatacgctctgcagcaaaaataccgcgcatccgcgcccaggtgttactgtcgaccgaagcaacctgctgcttctgcgcggcggttaacatctgccagagcggatcttgttgccagcgtttaacaatgctctcttcgcgatagtgggcaaccagcagccaggcaggattgaccgccagcagttgctccaggccgatggacggcatggacgcacccgccatcgcagcgggaacgttcagccccagagaggccagcacgctgccggtccaggtctcctgagtatgcaggttgaattgctgttcgcgtgatgtgccaaaggccacgcgtgtccctttgggaagctggctggcccactgcgccatcctctctttatgttgttccagacgtgcctgcatctctcgctttttacccaccatttcgccgatgatagccgcagattgcaaattttcagcgtaggtttcgttgcgggacttaagcagcagtaccggcgcgatttgctgcaaggcgatgtaaacccccgcatggcgactgctgtcggcaatgatcaggtctggtttcagagcggcaatggcttccaggctcggctgcgcgcgcgttccgacggactgccacggtttcaggtgcgcacgcacttcgggcaggatgcgttttgcatcgttatcgtcggcaataccgatcgggatgacgtccacggcggccagcgcatcggcgaacgagagttccagcaccacaatccgttgtggcgttttttcgagtgtaaacgtgccgtgttcgtcctgaaccgtggcggcaaaggcgtggctgatcaccagcagcaggcctgcaaaaagaaaacggataaatgccaacataatcacattccagctaaaagcccggcaagccgggcgttaacacatcagaacttcaacgacccctgcatatacagcgtgcgcggctggcctgcatagatgcctttgttgttgtcgtcataagagcggatgaagtagtcctggtcgaagatgtttttcacaccgaatgccaggttcagatctgccatctgcgggccaaagtcatacgccacgcgtgcgccccagagcatgaagccgggaatgcggccggtactgccgtcggcgctctctttcaccgtattggcgttatccgcaaactggctggactggaaatcgctgttcagattgaacgtccagtttcctggcttgtagtccacgcccagcgtgcctttatgtttcggggagaatggtaccagattgccgtaggtgtcgcctttctcgcggatttccgcgttcacatacgcatagctggcgtagatggaaacgttatcaagcgttggcgttagcgtacccagatcgtaacgtgcctgcgtttccagcccggtatggcgcgttttgccacgtgcagtgacggtgtcgttggtctggttggagtcgtactgattgttaaagttaatcaggaacagccccatttccgccgtcagcgcgccgtcgtcgtagcgggtaccgagttcccaggttcgcgctttttccggttcaacattgccgctttgcacagccttgccaatctggctgtactgtacggtgccgaacgagccttcagtgtttgcataaagattccagctgtcagtcaggtgatagagcacgttcaacgccggaagcggtgcgttatagctcacttcttcgtgcgtgcctgtgatggcgttgttctggtatgactcgatatgttcgaaacgcatacccggcgtgatggtccagttgccgatgtcgattttgtcatccagataccaggcgtgcgcctcggtgccggaacgcgtatcgcggtcgtaagggcttgagccggacggcaactgcccgctgctggtggcggtgtagtaacgcatttcatgcgttgattcattcaaatagcgatagcccacgcccacttcgtgcgcggaagggccgatcataaagatctggctgtagcgtggctcaataccgcgcacccagtagttacgcggcgagagggtgatgcgtttgccttgctccaggtagccgctgcgcagggtttgggtgtagaacccctgaatgttgaatttatgctggctgtctggctggaactggtagcccaggctcgccagcttgcgacgaccccagaagcggtcatacgggcgggtggattgccagcgatcggcgtcgtaatccgcgcgagacaggccaccgggcatgtcggcttcaccgtcgtaatattgcagcaggctgttgaaggtgtgcacctcatccggcgcatatttgcttttcagcatcaggtcgtcgatgcgggtggcgctgtgctcgcgccagtcactgccgcgcgtgccggagtagagcagcgcggtgccaaaaccgttgtccgctgtgccgcccaccatcaggttgtgcgtctctttcgggttgttttgtgaagaggttgggctgagctgaccttccacgcccgcctcgataccaaagtcctgcggaatggcacgggtaacaaagttcaccacgccgcccacgctctgcggtccgtaacgcaccgcaccaccaccgcgtaccacgtcaatggcatccatgttgccgagcgaaacgggagccagtgaaagctgcggctgaccgtaaggggcgaaggggacggggatgccgtccatcaggacggtcgagcggctggcgaggcgcgggttcaggccccggatgccaaagttcatcgccaggtcgtggctgccggtgccgttgttttccggcgcgctgacgccagggatgcggttaagtacctcacgcatggtggttgcgccggttttggcgaaatcctcacggcggatcacgtcacgcgcgccagcatgttcaaatacgtcgttttcacgcgcatcacccagccagtcgccgaccacggtcagggcatcttcttttggtgcgggcgcgggctccagcgtccagctgttatttcccagcggttttacctgcagtccgctgccgtccagcagttgttgcaggccgctctcgacgtcgtaatcgccgtgcaggccgttgctctgcttgccgcgcgtcaggctggcgtcaaccgagagggtaaatccgctgtgtgcggcatactgattgagcgctttatcgagcgatcccggtgcgatattaacctgtgcagcaaaagcggaaaacgagagaccggccagcggcagcaggctcaggcgaatggtgttaaccaaaggtgttgttttacgaaaaacgcgtaacggcgtcataccttccccatcatcatttttgttgtgttcagctatgagtcgaacgagaagggtaaaaaggacaatcgaaataagaattattttccttacagtggtgaaatgtttatccagtaccgcgtaatagactgaattttaacgggaagcgtttgcgcgataacgttcaggatcgcatcggtatttttcagcgggaacgtcccgctcaggcgcagcccggcaacggcgggatcgcagcgcagcacgccgttgcggtaacgggttagcgtggctatcacctcacccagcggtttatcgctgaagctcaggatgtccttcgtccagcttgtactctcgtcatccagcggtttcactgcgccaaactcagaggcgctgaactgcaggctttcaccagcgttcacgatgcgtttttgcgcgggggcactggcgagaagcacttccacagcgtgctgctgcacgtcaagctgcgtgaaattatcctgctggcggacggtaaattctgtccctaaagcagtgagctggccctgacgggtcaggacacggaaggggcgttgcagggcatctttcgcggtagtaatggcgatttcaccgtaccagagccggacggtgcgctgatgcgcatcaaaacgcacatccgccgcgctttgggtattcagcgtgagcagggagccatcttccagttgctgacggctgactgtgcctttggcggtgcggtaatctgcccgcagaccttcgccggtttccgactgccagagctgccagcctccgccagcgccgagcaacagcagtaatcctttcatcacgtgacggcgggtgaggcgggtatcgtgcaacgcccggctggcaacgtcgccaggcacaccgccaagctggttgcgcaggttttcaacctgctgccaggcccactggttatcctgatcctgttcataccactgttgccagcgcgcttcctgttgtgggctgacgcgctcgccgcttagcacggcataccagtgggaagctgaacgcagcgcctgacggcgggaatcggttaacaaaggattcataacccatactccagacggaacagcaggcagtgctcgacggctttcgccacgtattttttcacggagctgatggaaacaccgagtttgtgcgcaatctcgctgtatgtcagaccatccagttgcgaaagcagaaacgcttcacgtgttttgccgtttagcccgtccagcatgctgtcgaggagttgtagggtctcgagttggctttcgcgttcctcaggtgaaggcgctcccccctccggcataagcgccagcatctccagatacgctttttccagcgcgtttcggcgaaacaggtccaccatcacgcgtttggcgatagtgcagaggaaggagcgaggatcgcggatcgtcgagagcgtttcgctgaccattacccgcaaaaaagtgtcctgggcaatgtcatctgcatcaaaagcagactggagtttgcgcgtcagccagcttttcaaccagccgtgatgtgtgccataaagcgactcgaacgttaaggaagctgtggtagtggcgcggtcagacatgcggagtgcatcaaaagttaattatcacgtagtcatattaatatgagaatggttatcattacaattggaaataaaattgtttccaatagacatttttaacatgttgtttttctaagtgttataaggtaggtataaaatgggatggagcctctgcttctggcatgtgtcggtcagaatgactcatgatgtggtctgctattattgacatcctcactgccctaaaggatggggatttcggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctccttgccgtaaaacatggcaactacagttcacttacaccgcctctcagcccggtaagcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatagatgacggatggctggccgctgtatgaatcacgcctgaagggaaagctgcacgttatcagcaagcgttacactcagcgcattgagcgacataatctgaatctgagacaacatctggcaaggctgggacggaagttactgtcgttctcaaaatcggtggagttgcatgacaaggtcatcgggcattatctgaacataaaacactatcagtaagttggagtcattaccgaccatgtttatttcatacattgtgggtattgttcttattatcgccgctaatcaataaaatcctgccccatatctacatggggcagttgttcattcttttagtgtggtaattcacacgccagcaaaaactctgccgttccttcatcaacaatcaggtccgtgacatatcctcccagcagggcacccaacgttgcgtcatagcctctttccccaccagcaaggaagatcttccgttcaatctgccttagctgagccagactgattcccagaatacgctggtcaacatcagccacgacgggcatcccttccttgtcatagaagcgaccacaaatgacacctactgcgcctaaatcccgatacgtctgcatttccttcttattcagcacgcccacccgaatcaggggattttcatcaagcgcgttacccacgacaaaaaaggctttcgtacagcgagtcagaacgtcaaaattcgatcgaataataggctctgcctgtaactccatggccagtctggcgcttgataccacggcgggcacgtgcagcgaggcgacacggcctgaaagcttgtaggcgatttgcgatgaggattcaatgatcgtcaggtctggctgagatggcatggaaccgagcatctgtataacggtgacatttttacatgacttcggcgtcatggttttgctcatctgatggattgttcttccccaggcaacccccagcacatcaccattctcaatcacctgattcagatacatgccaccggcacgtgaaaggcgagtccgcatcagctttgtatcatcacgttttccggcatgttcgccatccggcacgatgatcactctctggagattgaatttatcgcgaatttgcaaagcagcgtcgatagagccaaagacattcacatccaggttgatatgaaccagtccattttcccgggctgtttgcaggtatttgacaaccgtgacgcgggacacccccatgatagctgcaacttcagtctggcttttgccttcctgatagtacagccatgttgcatgaagtacgggatcatcattgaacaggctgctgtttgtttgatctctatccacttttgtatacctgtattaaaccggggaaatgctcatcttaaccctgtttacccggagagttgatgcagattgccagtggcatgattttatacagatattttattcttttacatgaaataaaccagcataccatttgagcgatcgcccgctgttcccccatactgtaaagccggagacatgctccggctttacagtattactgagaatacacccatcaagcataatcgaaggttcaatatcgcccctttttgatcgccagcgattcgtcaccgtgcagacggttgccgtcactcactaaattatgggggacagtgaacaacaggttggctcactggcaagaacccgattataaaactaagctggcgagcagaataaaaatcagcccactgatggataagagtgtggacatcagcgtccaggataacagcgtttctttggtggtcaggccaaaaaagtctttaatcatccagaaactggcatcgttaacgtgagaacaaatacaggatccggcaccggtagccagcgtaatcaaggccaggttggtattgggatgtactgccaacaatgggatgaccagaccggcggtagagatcgccgcgacggtggctgaacccagacaaatacgcaggaatgcggccacgccccaggccatcaggatcgggttaatatccatacccgaaaccagggtggaaatatactgaccaacgccagagtcgatgagaacttgcttgaatgcaccaccaccaccgataatcagcagcagaccggcaatacccgcgatagcttttccgcaagaatccatcaggtcagggattgttttcccgcgccccaggcccatggtatagatcgcgaatagcagtgaaatcagcatggcgatcgttgaattacctaagaacagtatcacgttgtaaaataagcctgaatccgcggcacttttggcatgagtcatctggatgatggtgacaaccgccatcaggatcaccggcagcattgccgtgagaaaactgatcccaaagcctggcatttcgctttcgctgaatcggcgggtcgcgccgagagaggctatattcccctcttttttaaaggcgtccggaataatgcgctggcagaatttattcaataccgggccgcaaagaataaaggttggaatgccgacaatgataccgtatatcagtaccaatcctacatcagcgccatattccctggcgataacagtcgggccggggtgcggcggcaaaaaaccgtgtgcgaccagcaaaccagaaagcatcggcacacacataaacatcggtgatatttttgcttcacgggcaatagcgaataaaataggtaccagaagaattaaaccgacttcgaaaaaaagtgcgataccgacaataaacgccgaacagaccactgcccagtcaagtttatttttcccgaaataattcagcatggtcagcgctattcgctgcgcaccacccgcatcggccagcaagcgaccgagcataacaccgaagccaaatatcaaaccaatatggcccagcgtaccgccaagtccggattcgactgaggtgacgactttactcaaatccataccactggcgatggcgacagcaatcgagacaataattaacgaaacaaacgtattaagcttaatttttatggttaaaagcaggagtaaagcaatccctgccacaacgataattagtggcataacgtcctctcataacagggtagcgacccatcattatccgactgagcaaataacgaatgatgcagagtcggataattcaggtgtctggatgtttttatttatgctttcagtttttattcataaaatcgcgcaaagccgcgccaattttgtttacatcataaatacaaccggtccatgtcccaccactcacggcctgaagcattgcccatagccgggtatcatctggcaattcaggatcgggaagtaaatcctgatggctgggtctggcatttaatattgcagttgcctcctcctgtgaaggtaattgttcatcgctacgggttccgaggaaattgacttcgccgtgaagctcgcgacaatcaattttaatttcaattaaatccccggtgcgtaatttaccgatggggcctccggccagcgcttctggccccacatggccgatgcacgcgccagtagaaacgcccgagaaacgtgcatcggtgattaacgaaacatgcttaccgtatgacagatgcttcagggcactggtaacctggtaggtttcttccatccctgtacctgaaggtccaacgccaataatgaccagaatatcgcccgccttgatcttgtcatgtttgatatcgtaaatcgcacttttctcggacagataaaccttcgccacacctttatggtaatagataccttgctcatcaatcatcgaggggtcaatggcggtggatttgatcaccgaaccttctggcgcaatattgcccaccgggaaggtgatagttgaggttaatccgcgcgcttttgcttgctgcggagacatgatcacttcgtcagcgttgatttgttcctgatcgagcaggagttgcttgaaccgctgacgccgttcggagtgctcccaccagtcgaggttttctttcagcgtgctgccggtaaccgtcataacgtcttcatgcaacaatccgaggctgcgcagatgcaacatgacttccggcacaccacctgccataaaggcattgaccgttggatgataaaccgggccattaggcagtacgctcaccagtcggggcacgcgcttgttgatgcggatccagtcatcaacggtcgggatatggcaacctgcctggtgagcaattgccgggatgtgtaacagcaggtttgttgaaccaccgaacgcggcatggaccgtcatcgcattctctatcgctttatcggtgagaatttcccgggtggtgatgcctttttgactcaggttcagcgcagctcgcgcggaagctctggcgatctcccgccacacaggctcaccggaaggggccagggctgaatgtgggattgccagtcccaatccttcggccaccacctgagatgtcccggcagtgcccaaaaattgacagccgccgccggaagaggcacaggctttacagcccgcacggcgtgcgtcctgtagagataattcgccattggcgaagcgtgcgccaatggtttgcaccttgccgttgtcttctccatcctttgcgggcagcgtcgcgccgccggggaccagcacggttgcgatgttgtgctgcgcggcgagtgccatcatggtggccggaagccccttatcgcaactcgccacaccaataactgctttcgcgtcgggcagagagcgaataaggcggcgcattaccatcgatgcgtcatttcggtatggtagcgaatcaaacatccccgttgtaccctgagtacgcccgtcacaaggatcggagacgtacacggcatagggcagggcatggttggctttaataacctcggccgccgctttcatctggatgtccagttcgtaatgcccctggtgcaacgccagcgccacgggtttaccgtctgcgccgcgtaagccaccgagtgtactgagcagtaaaataccgtcccgatccagctcgtccggagaccaacccattccggcattcatggtcataccgaacagatccccgctcgggcggttgataagcatctctgcggttaatgggagttcgccgtccgggccatcggcgtgcgttctgacggtgtaaatatcgtggctctcgtcagcaaaaatattgcgaacagacatgagtttctcctcagactggtaaaatgccctgcgcggtaagcagcacgtggactttatcttttgcttcttcagatgcttcaagaatcggtggtaagcaatatgtctctacaggcagcccgacacactgcatgctgtatttgatcagtgagacaaacggtgtttcgagggcgtaaatagcgggcagttgtagtagttttttattcagcgtcgcagcggtcgccagatcgccttcacgccaggcgcggtagatgccgacggagagttccggagcaaagttagcgctggcggttatcgcaccgtcgccgcccagcagcatcgtattcagcaaatgatcatcgtaaccgcagaataccgaaaacgacgggcgtaccgacttaactgtgttgatcatcgtacgcaagtgaccaacgctgtcgatggtgtctttgatgccaacgatattctcgttttgcagagccagacgcgtcacggtttccggggttaagtcctgacccgtcagatccggaaagttgtacaggatcaccggtagggtgacgctacgggcgatctgctggtaatagtcgtcaagatttcgtggtgcgactttccagtagtaggggttgatggcgacgataccatcagcgccgtaggcttgcgcatgctgcgccagtttgaccgcttcgtcagtggaaggggaaccgacgccaatcaataccggcactcgcccgtcgacaatggttacagcttcttcggcgagtgccatgcgctgggctgtattcatttggctaaattcaccaccggtacccagataaaacagcccgtcgacccctttattaatcaggaagtcggcaacttcgcgcattgcctttttatcaagggttccgtcacgatgaaacgtgctggataccggtggaataatgccgctgaattttttcattacctcagtttccttttcgtaagtgctcattttcgtttctgtatcccagcccatatgatatttgctcagcgcatttccggagcaattccagatagctgtctatcttatttcctgaataaactaccggatcgccagaaagtgagattgcatagttaactctgttatacatattgaataccggcatacttaaacataccgccccataggttgattcttcgttgtctatggcccatccccgaaggcgtgttttttgtaattcttccagaaacaattttttatcggtaaatgtattgcgcgtatgtggagttaacgtgagtgcttctaaaaaataatccagttcttctcgtgtcttccaggctaataatgccttacccaacgcggtaatatgcaactcaagttttttgccaatccagcttttgctcgtcggtacagagtccggactttcgatcttgtcgagatagatagccgaaatgctctccatcgccccaagatgacaaaccagtccacttttcagcgacaactcctgcattggccgcttagtcacctcaaatatattttgacggtgtaacgcctgacaacccaattcgtagttttttattcccagtgaatagtagccgtttttgtttttaattaagaaaccacaatccaccattacattcaataaattaagcaggctgcttttggggtactggaatttatttaataactccatataacttgccataccaacccatgcaatgtgggttaatattttttcagcacggactaatgaattacaccctttgcgaaccataatggctcctccttgctcatggaataaatggtatcggcattacatagtggaaaatatgctttgttcagcatgctgaaccgtaatgatgtgattaaatgtgatcttgtacacactttgaataatgaatccagaacagccacatttagtgaatgagaataaaaagtagatggcgtgttgttgcaacatcgtagtgtgtggattgcgcctagagcttctttattcgttcgagcgcatcgccaatattttctattgggtgccattgattatttttgcttgaaatccctctcgaatgaacttacttatcactttattgaatgaggtaaaaacaactgacatccggctcgctgataacgctgtgcaatagtctcaggtaacccgctgtcactgatgatcgttttaatacatgatagtgttgctacagcatgcggctcaacggcatcaaattttgagtgatcggccatgagaataacttcacgcgagcgttgaataatccgtgttttcaccccgacctcaaacatggtggcattggtgatccccgtctccagcgacagcgcatcgcaggagataaacgcacgttctacggaaaaggcattgatcatctccagcgccagactctctcctaccgaaaaataacctgggcgaatcagtcctccgataatgtaactttccacatggggaaaacagcccagttcattggcgattttaatgtcgttgcagatgacctttacccgcgcatcggccaggcatttcgccagttcgaggcaggttgagccggagtcgagaaaaaagcagtcgccatctttgatcattgttcgggcaagggcagctatttctcttttcgccacagattgcaatgtacgtttcacgtcgaagacgtactctttgtcgtctgtactgtcgtcgaagtccaggcaaccgtgaccgcggatcatgcctggatactggttgacaatatactggaaatcacgacggacagtcgcttccgcatagccaaaaagctccatggcctgctgtgtggagaggtgacgatgttgccacaggtagtgcagcatctgtttgatacggtcaggtctctgttggctcatcagaaacaatctcctcttacagggtggcgaattgagctaaggtcgcgcgatagtcagatgaagagaacagggcgcgcccaatcaccatatgttgcgccccagctgctgccagttgctgtgcagctgccagcgtaattccaccgtcggcccagcactcggtctgaggaaaagccgtgcgtactttttggattttctcgcacatggagggaataaaccgctgtccctgcccatcgggctcactggtcatcaccatcactccgtccagctcagacgccagatatcgccaggcgtcgatcggggttgccggattaaataccagtccggctcgtgcgccggtatggcggatctcagttaacgtttccgaaggatagtccagcgtttctgcatgaacgaagatccacgcgggtctgatttcagccagcgcgttaaaccagcgctgtggccgggcaagcatgaaatgaaaggacaagggatgaggcgtctgtctggcgacggcctgcaccgttttcatcccaaacgtaatgttgttaatgaagctgctgtcctcaatatccagatgcaggctcccaaaatccagattgtccaatgccgtcagctcacgaccatagtgcagaggatttgcgctggcgagagaagggtgcaggatcataagcgcctccgttaacctgataccagcgcaaacagtgcatcgtctgtgctggcatttcccactgccgttaagcgttgtggcgaatcaataaactggctgatgcgctgaatggtcaaaatatgtgcgttggcatccgtggcgctgacgcagagaagcagccagacggggtcgcactcctcgttaccaaaggcgaccggggtgcgtagcgtggtgatactgacctgattatagtttgcgccttgctctggtcgggcgtgaggcaaggcgattcctggggctatcagataataaggcccccagttaagggtattttcgatgatcccattaacgtagcatggctgcgcggcaccataggctaccagcgggcgggtggcgatttccacggcctgacgccagtcggtggctttacgttgtgcctgtacccatttaatatcgttaatcatccgtcgttgactccatgccgattcgggttaatctggtagcgatccccgtcgatacttttgacgaaggcggcagggatcgcagaagggttattgctctttgccggggataagcgctctgcttatccccatcttatcggcgtatatgatgcactttctccataaactgactgactcgcgcctggtcaacgaaattggcaaaaacgccgtcctttttaaaggtggttgcggtcacacagccatcggcgatactgagttgttcctccacgttttccaggcagacgcccgtgttggccaacacgacggtgtcaggcaccgtttctttgacccgttttaacagcgcgctgtcggtacgcgtcccggcggtcaggccagaaacacagagcgcatcaggatggttgttaaatactgtcgatttagcaatagaacagatatcgcgattgcccagatacacggcggcctctgggacgatattgaacaaggttttcacttcgcctgcaccaatccggtgttgatgacggatggtctcaccgacgttagtgtcccagacgccaaagtcgctggcataggcaccggtaaatatctcgcggataaacttagcgccggtagccatcgccaggtcgaatgaggcgaccggatcccacagaacattcacgccaaacgggatgcggatatcgctcattaattgcccgatgattcgtgccattgccgcagtggtttccggacgcaccttcgtgagatagggaagactaaactcgttggagaacatgactgcatccaccccaccattttggagcgccatcagatcgtcccaggctttgtcgataacccagttcatccccaactgcgcatcaaaactcgggtcgccgggcaatgcacgtagatggcacatggcgatgaccgctttttccgtcccaataacctctttcagccaactcattgaaagtactccttattccgataattcacgtttacgtaagaacagcacgacgctggcgacaataccgaccgccacgacaacgccaataatcccaagcgacatcaattcagaaatcgaccaaccgaacatattgcccacggacaacgctgagatttgcgcactttcaccggcaaaactgaaaccgcctttgagcgccatttcagtgaagtaaggcgcgaactgggtggcgatcagcaggacggtaatcatcacgatgaccccgcttatcaacgtcctgaccaggtctccgcggtggataaccgtagccatacagataaagaacggtgctaccggcaggtctgcgaggggtaacactttgttgcccggtaaaatgctggccagaattaacataatgggtatcagtagcagaccgacagcaatggtggttggatgccccagcgtcacagcagtatccagaccgatatacacttcacgtcctttgaaatatttctggaagaactttcttgcaccgtcggagatgggcagcaggccctcaacaatcaggcggatcatgcgcgggaacaacaccatgattgccgcaacggtaatcatcagactggcgcaacctttaaagccttcaccagccgccaggccaaaaatcagaccgagcactacgccgataatcaccggatcgccgaccatgccgtagcgtttctggatctcctgagcatcgatattgcgtcccttcatgaaagggattttttcatagatagcatcaagtagaacgaaaagcggtactgaactggaaccgtagccttgcggtatcgaaataccttccagcccgacgatgttctgtacccgttttgccgtccagtcggccatttttaacgatagcgccgcatggcagattgcccccagcacaccataaatcaggctaccggtcataagctggaccaccgtacccgtaatggcgtagtgccagtaattgtaaatatcgacgttcatcgttttggtcagacgggtgaccagcatggcgacattgagaagaaaaataactgggataatcatggcgccaatggctgtcgcataaccaacgccggaggcagggcctgcgccaacgtcaaagacatgcagggctaggccgaaacgctcaatcatcactttgatagggggactgaggctgtcgatcgccatgacgatcaccagtcccataccgacaaaaccaatcccaaccgttacccctgccttaatcgcctgcagccaggggatgcggaagataaggccaatcacgatcatgatgatagggacgaaaacggtaccgccgagagacaggatgtaatcaaacataatgcctccttttattgagttaacagagccttgatttgttgttttaacgcgtcgtcgttgatccctgtgagcagggcggcgccattaagcgtagggatgccgtaatcactgttggttcgcatggaggttacaataaggtccataccgttacagttaagagggatctcattcagacagcattgggcggtagtggctgaaatgccctgttcagtcaggaactcttgcagcttgtgtgcaatcatggttgaagtcgacatgccggtaccgcatgccacaaggatctttttcataatggatgtgcctcttgtgtagtgcctgaatcaggctcaacggggaaatgtgctgctgacatacctgccagagcggtcaataggcggatgcaatcagtcaaatcacgcaggctggcaacctccgccggagaatgggtatagcgacaaggaatagagagactggcgcagggaataccatcctgctcaacctggatataaccggtttctgttatcacgccgggagccacttctcgctgcaccggaatgttgtgttcaagagccgtctgttccaacatccgtatcaggcgaggaggcgtgattaatccggccagcgttccccgaccatggtagttcaggcaggtgatcccaacgccctgattaatcctgacctcggaataatcgtgtaaatcaggggtgtcacacgatggagtgatatcaataccaatcgccaggtcaggttttacacggcgtaatacgggaacaatgccgcggatattaaattcttcctgtaccgaagccaccagataaacggcgatatcaagctccatagtactgatagcatccgctacaccgagcagggcagtacagcctagacgatcgtctagtgctttactgcacaccagatcgtttgccaggagttgcggcgggttatacagagtgacaggcgtaccgacctgaatgcccatccgtatagcgtcgtctttgtctttggcaccaatatcaatccacagtttgtcgacagaaggtgactgcgtgcgctcgtcgcctttggcaaagtggtaggacttaatgccgatacaccccatgactggccctttgtccccggtgagggtgacgatggaaccagccatagtgacctgcgcaggaccgcctacgcgttcaaagcgtaaaaatccagacggctctattttgcgcaccataaaaccgacttcatccatatgcgcaaaaatcatcagtcgcagcgcatcgggtttatcactaccgtagcgcgcgacgacattcccaagcctgtctcgccagacctcttttgcctgacgcctgaattcgcacagcatgacgtcagcgacagcgttttcgtgtcctgaaatcgcattgtgctgcaaaagcgagaacagggtttcctgcacagaaaatgacatagctatctccgtagaccgtaaaacaatcactcgttgagcgttttataggcgcagactggtcgaataattgtgagaacgttcacgtgaaaacgcgcaaagctgaacaaataaaaaattatgtgagccgagtggaataaaagcgctcaacgtttgtgaaagttacgggctggagagaccagtgattatggttgaaataatgaggatgaataaaacgcggtaactgttatagcaccactttgttgcaggacgctccctcttcattacgtcctgcacgtggataccccagcatctccatcagcggatcttagaatgtaatggcgcgtggcaggtcgttggttcccagcataatgtaagaaaacatcggatctcctgaatagattcagagggagtatagataatcagctcaaatcactctccgctttatgagcccaggctggcattgccgtcagataacgttttgcacgcttatgtgcttcctccgggccgactttttgccaggaatcaaggaagctggctaaacctgataccgcttcttcccagggtttgagattgccgttgctgtcgctgcattacgcacaatattgatcactggcactgtgtgcatctggtgccgacatcggcattccgcaagcctgacagaactgttcatgttgtgacatatgatgctccttatggtgacatcttgattaataaacatactgaatatgtattgtgcaggtgatacatcagatcaaagcaaaggtaaagcctcgatatttccagccagaaataccgggaacctgttgttaccgggcgatgagtgcgaacacgccccagccaaagcattcccgcgcgtaggtcacgtagcgtttcggcgcgatgtttagttcggccctgacttcggcggcgaagtcatcgtcaggattcgcttccagccagcggcgcatggtcagccattttgcggcttcataccggtcccagccttcctggtctgccagtaccatttccaccacgtcatagccgagatcgtcgaacgctccgacaagtcctggcagcgtcaggaaatcgcttgtcgagctgacgccgcaggcctgggctatttcttctgttgctggtagctgacgccagtagggttcgccgataagcatgatcccgcccggtttcaggctttgcgctagcagctcctccgccccggcaaacccaccggcaatccatgtcgcgccgacgcaggccgccacgtcacatttttcatttgcgacgtaaccggccgcatcgttatgaataaaatgtacgcgttcgctgacgccgagttcttccgcgcgacgctttgcctgcgcggtgaagagcgaactcatgtcgatgccagtccccgtaatgccatgatccctggcccaggtgcagagcatctcgcccgagccgctgccgaggtcaagaatgcgggtgcccggcttcatgcgcagcacgcgacccagcgtggcgtacttctcttcggtgaacgggttatggatgcggtgttcactttcgctgatggtaaaaatacgtgggatatccattatttaattcctgttattgggttaagccttaaaaaggacacaacaagattgttattcacgtcagtgctccggtttcatcagggtctgcgcaccggatgtggccggtcagggtcatgggctgagcggtgagtgattgcatcatccagcaggctttgtgctcctccgggatgggataaggtgccggatagcctttgtctccggcacagggttcgaacccatgtcgggggtaataggtggcgtggccgagaacaaaaaccgtctggcagcccatcaacctcaggtgctcgatgccagtgcgtatcaaccgtcctcccacgcccatcccttggtattccggtatgaccgccaggggagcgaggatgtgcatcaacggtgaatccatttctcctttgaaggttgcccgggtaaataaaatatgcccgacggctttgccttcataccgggctagcagcgataacgcggggcgcgcgctttcatcctcaagtaaagaggccactaaatcggcttctttgctgaagccaaatgcgcgggtttcgacttcccggatatcactggcatcacttttatctgtgatatgaaaagtgaagtggtgtactgtcatagaaactctccttagcgattatcgagctgagcgcgaactttattcagctcggtggtgttgattcgatagggctggccattgacggacttgataagttttttggttttgagttttttgaagacggcgagcgtgcagtcggtcagcaacagcccttcgcggctgtagcattcaacggaagtgacgcggcctgaagaatcgcggacgtgcgcaatacgtctacctttagcgagaacgtgtaaggtatgttgttcctgacgggataaattcatactgaagaacctatttaatcatcatgtgcaaaacgtgcaaacacaccgcggtgtccgcattcgatttcggcgcattgataatcagtccggcctgaaaaggtcggggaactgattatcggatgattacattctccagcatcaaagcctcgggttgagttgaaaggtatttacggagcgaatattaacacgtagttataggagggatatgtttcagtagaaaaagtgtgatgtactttggaaattgaatgccaacccatttactggaaaaggcagatgacactgacgaatgcatgttgaagtacgcctgaaatggcctcatcggcttttcccttcgggagattattctccttttgttaaatccagaacataaatatgctcacccatcttcgatgcttgaaaaattgaagccaatcctgataagtaatttttttgaaagggtattttccggattcacaccggctttgatgagtgaaaaaccgttctcttttattcagtcaatcgtggcggtaattgcttcaattgcatatccctggcgagcataagcgggactgatggtatagccgagccaaaacacatcgcattgctgacgtaaatagatatcaccaatcaaaacctgcgtcatttgttgacaatggccaattgaatatcgcgagcaagtgtaagaactcccagcaagaccctgtaaataattctgtgtaactgcccacgattaaaggtggccgctcaggcggtcaccgtattcgataataaatgggtctggaaaaagtgcagcatctggcagcgtaatgcaggtagcccagttcaactctcactaccagtatgatcccaagttcgagcgcggaatgtatctgtatgagcatcgtcgctgtttcaataacatcatcgactactgtaactcactttgctatcacggtaagttgcagcctaaaagagggatggaaaaaggacgattttccccgcaatgggatatttacatattgatggtagaggcatgaagccaaatggagggagccgtcataaccctcttgaagctgaaacaatagcagcatggctggtggcacataaggatgatatagagcgccattacggggaaccactgtacaaagttgttggtgttgtgacgccattttcggcgcaggttaatgctatcaaaatgtcattgcgtaagctggaaattaatggcaaagacgagcagggtttactgacagtggggactgtgcactccttgcagggggcggaaagggcgattgttctcttttctcctgtctactcaaaacatgaagatggcaggtttcttgatagcaacagcactatcctcaatgttgctgtctcacgcgctaaagatagttttctggtatttggcgatatggaccttatcgagatgcagcccgcattttcgccgcgagggttattggcaaaatatctcttttcttcagataataatgcgttgcaatttgagtttcagaaacgacaggatttaatttccgcacatacacaaatttcaacgctgcatggtgtggagcagcatgatgaatttttgaacaagactcttgccggagctcaaaagaaaataacgattatttccccttggttatcctggcaaaaagtggagcaaacgggatttctggcatcaatggctttggcccgttcccggggcattgatattaccgtggtgacggataaaaactgcaatatagcgcatgtcgatgatgataagcgtcaggagaaacaacatctgctgaatgatgctgttgaaaagctcaataagatgggtatcgctacgaaattggttaatcgtgttcacagcaaaattgtgattgaggatgaagaactgctgtgtgtcggatcttttaactggttcagtgctacacgggaagataagtatcaacgatacgatacgtctttggtgtaccgtggtgaaggcgtaaaaaatgaaataaaggcaatatatggtagtctggatcaacgtcagctttaaatgtgatgagccgttcatgatacaggagtagtaaagggcatattttaccaatgttaaggcgactttccgttttattgcgagtcgcctttcctgattataaatcttattgtttacctaatcattttcctttgcataatgcgcctgggattaatggcgggtgcttttaggaatgaaagaaaatgcaagcaataatataataatggcctaatttctttgaacatcattaagcatatcatcatcgtctatttgccagaatccgtcgacttataatcgccagaacggcatatcaggacggtgctgcgaacgctgtggcccaaaacgttccagtaaactgtgtagatgttcgtagatttccgagccataatcgaaaaggcgcggatgtctattaaggcatccggctaatctgtaagcaataacaacggtttatgcggtgcgcgtttttcacccttgtgccagattattatattggcaattgcctgctgttcgagcccgcaagtgaagagatattaccttgatctcatttgttttttgttgtctactctgagaacgaacaaggacatcccccatgaataaactccccgctcacctttcgcgccaaaactgcaaaattgcttctacaaatctgtcagaaataatcccccgacgggctgcagtgctgaaatgactgcttcgcagtgccgtcgtccagttctccggtgaccggtacgctgaaccgtaatatcccgtgcttaaatcgtccgggtcttcatcaggcgcgttcgtcagtcctctttcaccttgttgctggaagtcgacgaaaataatattggctaaaacattattttgataattgccataaatagcttcatacgaatgcgggaaattttctttccagtaccaggtggtatcgccgcaaaaccacggcgcgtcagtaatattattaagctgagaatggtattgttttagatccctacgaaaggcttcaaccatatgattaaagtgttgagggtgtgacgcgtagtcactggtcattaagtcaaattcgccttgcatccagcatgcgccgaggaatttgttctgcggattttttgccagtgcggctcgcgttctgctgactaaatcctggtacagcggagtatccgttccccaacgacaagcatcatggctggctccgtgccgttctgaatatgtcccttcgctgcccgcggtaaaagccgatccgccacggcaacacggaacgataagaatccctgcattatcaggaatgaagggcagtaatttccgtgcaatatgcagtgcctggccaacggtgccgtactgtgtttgatgattcgttgccagaggatggtgataaccctgcatatcctgaacatcgtgtgggcagtgagtcagtggaataatgtcgttaaagtgacatggcgggcctccgggatgcgtatgcgcaaatctcgctaattgtttaattctgggatgaggcgcatcttccctgtccggtaatggcagtccttcgccatacgccatggcattagactgaccagcaacggtaagaacatagtaataatcgggcgatattattgcgttcatataaatttcgcgtaattgaaatgacaaattgatagcagggcccctttaccggggccctgaagcgttagttttgtactgtgactttattatccttcacagtgatcaaaactgaatccgtcaccgctttgccgcctgcagtttcaccgccaataatcaatagactattattccagggcaatgatactccgtaggcccgaccttgcgataattcacccgatttatcccatttcccgttatgccaaagatgaatatcagtgctatatgattttttcaggccttcatgcgcatagttcttaccgttctggtaattttctcgtgaacctttgaatccggcccctccggcaaatataagagaatcattgcttatccccgcaaaaccgccagctacgccatctggtgatgagacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggcgattcgccagcgtaactccattgctgtgttgagggatcaaaagacaacagaaacttattgaagaaataatcttctgcttttttgtcaaaatagtgagcattgattttatctatagcggttgaatcttttccagcctcgttgagatcttcaaaatagccattgaagatattctggttaacaccaccagtaacataagccttgccgttgtgtacaaaagtcacatggcccgccatgcccatcggcgcgtgcgacatcaatttaacccaactattggttttggggttgtatttgtgtacgtcattaaatacctgagtcaagccctcgctgtttttgccaatgccgccaaacacatacagattgccatcaataaatgcagaggttgcttgatctcttggtccgccagggaatgcagctaacgctgtccattttttatctttggcctgtgtatccagcttgtaccatgccgtacctgcgctacctaaaccaatgtagacagtgtcgttatcaattgctccggtaccacttttaaatggcacaggagtttccggtaatacagacgcgtttgcggcaaatgaagccatcatgatagcaagcgccgttattgttttattcattgtgactgtctcctgtctactacagtttaaatgacacaccaatgcgataactgttttccgataaattatctctgccgttgtaaacaccctgacggtcaaggtagtcatattctatgtatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatgcttgcccaccatccattttgccatccctcactgactttgagtcgagtctcataggcgtggcttccactacgatatccaccacgtacgtccagtgtcgcagcctgagaaattaatggggacgaaaagcacagtaataatacgccagaaagtattttagcctttttcataaatttcactcatttgtaggatacagaaagcaatacaaagcccgcataaacaattagcatttatgttgtgtaatatttttttgccaggcttatagtgtctttggcaaccggtagctgtattttatatttttttgtataaggtctcctgtgaaaaatctcttttcacattatttaaataaacagagatccagattaaatacctgagtataaaatctcttctgatgtttaattgatttgaatgttcgtaagctatatcacttactcaatccattttacccagagtcataaaatagaatgtctgttgatctcattttcatattcctttcagactgaagtgcgttttcatcacccgatgagaaagaactgaagtgatgtttgccatagattgcgagatgccctgtctcattgactatcttggtgcacctttatacctgttataccagatcaaaaatcacgcaatccatacaacaaaaccagatttgcaattcgtgtcacaaaatatgtcgatctttttctaagaggaagatgccatgtgaagccagacgaacacttgcggtggtcttcaaaaactaaagatcttagtttaactatttgttttataaataatttattaagagtctaaacaaggggagctttgcaagctaactcagtgagcttggtgaaaatcagtgtttacccgccatcaggctgagcataattctcatcatgaaatatgtttcctggtttgtggcttgtaactggtcacttctgaagtcgatctggagaggcttgttgatgttggtgttttcaggatgatgtttcacttagtttgtttgccgtatcgcccggcgaatggctgtgattgaggaaggtttaagtcgtagtgaccaaagctatatttaccaacgaatgtagatgaaaaaatcatctcctgcgttcccccatatctctaggataaaaaggaatgtaacaatctcatggcgtaagctgacgaatcagcaggaataatcgctagggacctaagaattagcatgataatagccactaagaaattactgcgctccatgaaatagccattttgtggcaaatggagttgactaataatgtcatatgtgagacggctagttgaacgaatattaaattttgctgaattttttatgttgattttacttgttacagaacatatcacatgatatatagataagattagttgcattaatgatgagggttattattagattcgtatccgattgataaatatataaaggtacatagcatgcaagagcatggcgtttgtatggcaacgttattataattaacagttgctactccatttaagttcactcagaagaactggtccacttacgttagttattaagcaaacgttcgcttttataaacataatcaggataaaaatgttggattattgctaacccagcacagctagtgcgcgtctgtaattataagggaaaaacgatgaagaataaggctgataacaaaaaaaggaacttcctgacccatagtgaaatcgaatcactccttaaagcagcaaataccgggcctcatgcagcacgtaattattgtctgactttgctttgttttattcatggtttccgggcgagtgaaatttgtcgattgaggatttcggatattgatcttaaggcaaagtgtatatatatccatcgattaaaaaaaggcttttcaacaacgcacccgctattgaataaagaagttcaggctttaaaaaactggttgagtatccgtacttcgtacccgcatgctgagagcgagtgggtatttttatcacgtaaggggaatccgctttctcggcaacagttttaccatattatctcgacttccggtggtaatgccgggttgtcactggagattcatccgcacatgttacgccattcgtgtggttttgctttggcgaatatgggaatagatacgcgacttatccaggattatcttgggcatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtgtgattcttaattatcataataaacattaagttaaccatatccatacaaaatacaatggtttatgttcttcaaaataaataaacaaaatcattcataaatttacacatcacttaaaatctcctgtttccgcacttttttctttattttttaagcaactggaagttaatccactgcaatctattgttatattgaatcaaatcaatgaaaatagatgttgtcacatcagtgatattttatttttgtatgatatttaatgtaattgactgatagccacatcactccgtgtgtggttatctttttatctattgggctaattttgaccgattgaggtttcctataggtattcattcaaatatatctcagttaggagtactactattgtgagtaaacgtcgttatcttaccggtaaagaagttcaggccatgatgcaggcggtttgttacggggcaacgggagccagagattattgtcttattctgttggcatatcggcatgggatgcgtattagtgaactgcttgatctgcattatcaggaccttgaccttaatgaaggtagaataaatattcgccgactgaagaacggattttctaccgttcacccgttacgttttgatgagcgtgaagccgtggaacgctggacccaggaacgtgctaactggaaaggcgctgaccggactgacgctatatttatttctcgccgcgggagtcggctttctcgccagcaggcctatcgcattattcgcgatgccggtattgaagctggaaccgtaacgcagactcatcctcatatgttaaggcatgcttgcggttatgaattggcggagcgtggtgcagatactcgtttaattcaggattatctcgggcatcgaaatattcgccatactgtgcgttataccgccagtaatgctgctcgttttgccggattatgggaaagaaataatctcataaacgaaaaattaaaaagagaagaggtttgatttaacttattgataataaagttaaaaaaacaaataaatacaagacaattggggccaaactgtccatatcataaataagttacgtattttttctcaagcataaaaatattaaaaaacgacaaaaagcatctaactgtttgatatgtaaattatttctattgtaaattaatttcacatcacctccgctatatgtaaagctaacgtttctgtggctcgacgcatcttcctcattcttctctccaaaaaccacctcatgcaatataaacatctataaataaagataacaatagaatattaagccaacaaataaactgaaaaagtttgtccgcgatgctttcctctatgagtcaaaatggccccaaatgtttcatcttttgggggaaaactgtgcagtgttggcagtcaaactcgtttacaaaacaaagtgtacagaacgactgcccatgtcgatttagaaatagttttttgaaaggaaagcagcatgaaaattaaaactctggcaatcgttgttctgtcggctctgtccctcagttctacagcggctctggccgctgccacgacggttaatggtgggaccgttcactttaaaggggaagttgttaacgccgcttgcgcagttgatgcaggctctgttgatcaaaccgttcagttaggacaggttcgtaccgcatcgctggcacaggaaggagcaaccagttctgctgtcggttttaacattcagctgaatgattgcgataccaatgttgcatctaaagccgctgttgcctttttaggtacggcgattgatgcgggtcataccaacgttctggctctgcagagttcagctgcgggtagcgcaacaaacgttggtgtgcagatcctggacagaacgggtgctgcgctgacgctggatggtgcgacatttagttcagaaacaaccctgaataacggaaccaataccattccgttccaggcgcgttattttgcaaccggggccgcaaccccgggtgctgctaatgcggatgcgaccttcaaggttcagtatcaataacctacccaggttcagggacgtcattacgggcagggatgcccacccttgtgcgataaaaataacgatgaaaaggaagagattatttctattagcgtcgttgctgccaatgtttgctctggccggaaataaatggaataccacgttgcccggcggaaatatgcaatttcagggcgtcattattgcggaaacttgccggattgaagccggtgataaacaaatgacggtcaatatggggcaaatcagcagtaaccggtttcatgcggttggggaagatagcgcaccggtgccttttgttattcatttacgggaatgtagcacggtggtgagtgaacgtgtaggtgtggcgtttcacggtgtcgcggatggtaaaaatccggatgtgctttccgtgggagaggggccagggatagccaccaatattggcgtagcgttgtttgatgatgaaggaaacctcgtaccgattaatcgtcctccagcaaactggaaacggctttattcaggctctacttcgctacatttcatcgccaaatatcgtgctaccgggcgtcgggttactggcggcatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagagcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgcccggctaaattagcgttgccacccgatcaggccgcagaaaaattaagatttcgtcgtagcgcgaattctctgacgctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataacgcagggggaatttttcgcctgaataaaaagaattgactgccgggtgattttaagccggaggaataatgtcatatctgaatttaagactttaccagcgaaacacacaatgcttgcatattcgtaagcatcgtttggctggtttttttgtccgactcgttgtcgcctgtgcttttgccgcacaggcacctttgtcatctgccgacctctattttaatccgcgctttttagcggatgatccccaggctgtggccgatttatcgcgttttgaaaatgggcaagaattaccgccagggacgtatcgcgtcgatatctatttgaataatggttatatggcaacgcgtgatgtcacatttaatacgggcgacagtgaacaagggattgttccctgcctgacacgcgcgcaactcgccagtatggggctgaatacggcttctgtcgccggtatgaatctgctggcggatgatgcctgtgtgccattaaccacaatggtccaggacgctactgcgcatctggatgttggtcagcagcgactgaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataacagtagcgacagatcatcaggtagcaaaaataaatggcagcatatcaatacctggcttgagcgagacataataccgttacgttcccggctgacgctgggtgatggttatactcagggcgatattttcgatggtattaactttcgcggcgcacaattggcctcagatgacaatatgttacccgatagtcaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgatcaaagaggctgacggcagcacgcagatttttaccgtaccctattcgtcagtcccgcttttgcaacgtgaagggcatactcgttattccattacggcaggagaataccgtagtggaaatgcgcagcaggaaaaaacccgctttttccagagtacattactccacggccttccggctggctggacaatatatggtggaacgcaactggcggatcgttatcgtgcttttaatttcggtatcgggaaaaacatgggggcactgggcgctctgtctgtggatatgacgcaggctaattccacacttcccgatgacagtcagcatgacggacaatcggtgcgttttctctataacaaatcgctcaatgaatcaggcacgaatattcagttagtgggttaccgttattcgaccagcggatattttaatttcgctgatacaacatacagtcgaatgaatggctacaacatcgaaacacaggacggagttattcaggttaagccgaaattcaccgactattacaacctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatatcaactggacgctcagctatagcctgacgaaaaacgcctggcaaaaaggacgggatcagatgttagcgcttaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacgggggtgcgtaccgactggcgtggttatgccgtgctgccttatgccactgaatatcgggaaaatagagtggcgctggataccaataccctggctgataacgtcgatttagataacgcggttgctaacgttgttcccactcgtggggcgatcgtgcgagcagagtttaaagcgcgcgttgggataaaactgctcatgacgctgacccacaataataagccgctgccgtttggggcgatggtgacatcagagagtagccagagtagcggcattgttgcggataatggtcaggtttacctcagcggaatgcctttagcgggaaaagttcaggtgaaatggggagaagaggaaaatgctcactgtgtcgccaattatcaactgccaccagagagtcagcagcagttattaacccagctatcagctgaatgtcgttaagggggcgtgatgagaaacaaacctttttatcttctgtgcgcttttttgtggctggcggtgagtcacgctttggctgcggatagcacgattactatccgcggctatgtcagggataacggctgtagtgtggccgctgaatcaaccaattttactgttgatctgatggaaaacgcggcgaagcaatttaacaacattggcgcgacgactcctgttgttccatttcgtattttgctgtcaccctgtggtaatgccgtttctgccgtaaaggttgggtttactggcgttgcagatagccacaatgccaacctgcttgcacttgaaaatacggtgtcagcggcttcgggactgggaatacagcttctgaatgagcagcaaaatcaaataccccttaatgctccatcgtccgcgctttcgtggacgaccctgacgccgggtaaaccaaatacgctgaatttttacgcccggctaatggcgacacaggtgcctgtcactgcggggcatatcaatgccacggctaccttcactcttgaatatcagtaactggagatgctcatgaaatggtgcaaacgtgggtatgtattggcggcaatattggcgctcgcaagtgcgacgatacaggcagccgatgtcaccatcacggtgaacggtaaggtcgtcgccaaaccgtgtacggtttccaccaccaatgccacggttgatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacagtaaatggcggagccactcagggaaccattcaggcagtgattagcatcacctatacctacagctgaacccgaagagatgattgtaatgaaacgagttattaccctgtttgctgtactgctgatgggctggtcggtaaatgcctggtcattcgcctgtaaaaccgccaatggtaccgctatccctattggcggtggcagcgccaatgtttatgtaaaccttgcgcccgtcgtgaatgtggggcaaaacctggtcgtggatctttcgacgcaaatcttttgccataacgattatccggaaaccattacagactatgtcacactgcaacgaggctcggcttatggcggcgtgttatctaatttttccgggaccgtaaaatatagtggcagtagctatccatttcctaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtgagtctgggattaacggcaaattatgcacgtaccggagggcaggtgactgcagggaatgtgcaatcgattattggcgtgacttttgtttatcaataaagaaatcacaggacattgctaatgctggtacgcaatattacctgaagctaaaaacctgcacgttagccctttgtaggccagataagacgcgtcagcgtcgcatctggcataaacaaagcgcactttgctggtctgttcccctcaccctaaccctctccccggaggggcgaggggactgtccgggcacatttttagactttgtcatcagtctgagcctgccattggcaggctctggtgtccttttacgctaccatgctaataatcagcacaataatcagcccaaccacggagttgaccagctccagcagaccccaggttttcaacgtgtcttttactgacaggtcaaagtaacctttgaacaaccagaaagatgcatcgttaatgtgggtgagggtgttggaacccgcagccgtcgccagtaccagcagcgccggattcacgccaaccagctgaccagttgctggatctaggattgcagcactgataatcccggcggcggtcatcgccgaaacgacaccctgacccgtcgccagacgaattagcacagtgatcagccatgccatgatgtagggcgagatattgccgtgggacatcaacatgccgatggtgtcgccaatgccggtgtcgatgatggtctgcttcagcacgccacccgcaccgatgatcagaatcaccattgcaatactcttcaccgcgctttcaaaagcgttcatcacccactgcatgtcatgaccacgtgcggtgccaaagagtacgaatgcaaccaccatcgcaataaacattgcaatcggcgaggaaccgataaagttaaccacttcccaggcaggggtatcttttaccagccagatattggcgatggtggtagagatcataatgatcgccgggatcagcggcaccagaatcgaaacgccgaaagagggcagattattcatatctaccggttgatctgctttcaggaatgatggcgttgggcgctcaagattgccgaggaacttcggcaggatcagacctgcgcagattacacttgggatcgtcaccagtacgccatagatataaaccatccccatatccgcgccataagcattcaccagcgccaccggacccggctgcggtgggaacagtgaatgtgcggtagtggcagctgctactgccgggatcgccagtttcaggaacggaattttagcttcggcggcaataacaataaccagcggcgctaacatgataaaggccacttcatagaacatcgccagaccaaaaatcaggccgatgataatcaccgacagctgtacatagcgcagaccgagacgcgccagcagcgtatgcgctatctggtgagccgcgccggagtcgaccatcaatttaccgatgaccgcaccgaacaccacgatgatagccagttcccccagcgtgttgccgaagcccgctttcatagtgtgcagcagcgacatcaaatccatgcccgccagcatcccgacggacagcgccgccaccaacaaagccaccattgaattgattttgaacttcaaattcagtaccagcatcagaccaatgccgaataccacccagagaatgttaagcacatgcataacgttttaccttacctggttgaaccgttgttattttgggcgatatgttatgtaaattggtcaaccattgttgcgatgaatgtcacatcctctgatcaataaccatcgattaccctttgctgcaatttgcagcaacaaccatgagagtgaaattcttgtgatgtggttaaccaatttcagaattcgggttgacatgtcttaccaaaaggtagaacttatacgccatctcatccgatgcaacgccacggctgcggtctggttgttcatccggatacctaaacaactccagggttccgcgtctctttgctgtggaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgttgaagagatcctcaaacgcaaggcgatcattgaagacgcaggcctggtgtggtctgtcgtagaaagcgtgccaattcacgaagatatcaaaacccacactggcaactatgagcagtggatcgctaactatcagcagactctgcgcaacctggcgcagtgtggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaaacgcccaggcgcggaagcggattacaccgaagaagaaattgctcaggcagctgaacgcttcgccactatgagcgatgaagacaaagcgcgtctgacccgtaacatcattgctggtcttccgggcgcggaagaaggctacaccctcgaccagttccgtaaacacctggagctgtacaaagatatcgacaaagcgaagctgcgcgaaaactttgccgtcttcctgaaagcgattattccagttgctgaagaagtcggcgtgcgtatggctgttcacccggacgatccgccgcgcccgatcctcggcctgccgcgcattgtttccaccattgaagatatgcagtggatggttgataccgtaaacagcatggcaaacggttttaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaacccaggttactccgcaattggtcgtctgaaaggcctggccgaagttcgcggtgtcgaactggcgatccagcgcgctttctttagccgttaatatccaccggcatggctgcgcgccgtgccggttccttcttccttgccgtcactctttgaagacggattctggagtttacgatgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagcaccgacagcgactggggcatctgcgaagttaacctgatgccaggcaacgaccgcgtgctgatcgaaaacctgaaaaaacagcaactgctgtacaccgtagcggaaaaaggcgcagagagcaccgagctgaaaattatcggttcgatgaaagaagcgctgcatccggaaatcgatggctgcgaaggtattctcaacgcgatggcgcgtccgcaaacggcgattgtctctctaacggtcacggaaaaaggctactgcgctgatgcggcaagcggtcaactggatctcaataacccgctgatcaagcacgatctggaaaacccgactgcgccgaagtccgcgattggttacatcgtcgaagcgttgcgtctgcgtcgtgaaaaagggttgaaagcgtttacggtgatgtcctgcgataacgtgcgtgaaaacggtcatgtggcgaaggtcgcggtactggggctggctcaggcgcgtgacccgcagctggcggcatggattgaagaaaatgtcaccttcccgtgcaccatggttgaccgcatcgttccggcggcgacgccagaaaccttacaggaaattgctgaccagctgggtgtttacgacccgtgcgccattgcctgcgaaccgttccgtcagtgggtgattgaagataacttcgttaatggtcgcccggattgggataaagtgggcgcacagttcgttgcagacgttgtgccgttcgaaatgatgaagctgcgtatgctgaacggcagccactcttttctggcgtacctcggttacctcggcggctatgaaaccattgccgacaccgtgactaacccggcttatcgcaaagcggcctttgccctgatgatgcaggaacaagcgccaacgctgtcgatgccggaaggtacagacctgaacgcctatgcgacgctgctgatcgagcgtttcagcaacccgtctctgcgtcaccgtacctggcagattgcgatggacggcagccagaagttaccgcagcgtctgctggacccggtgcgtctgcacctgcaaaacggcggcagctggcgtcacctggcgctgggcgtggctggctggatgcgttacacccagggcgtggatgagcagggtaatgccattgacgtggtcgacccgatgctggcggagttccagaagatcaacgcgcagtatcagggcgcagaccgcgtgaaagcgctgctgggcctgagcggtatttttgccgatgatctgccgcagaatgccgactttgttggcgcagtgacggcggcatatcagcagctgtgcgaacgcggtgcgcgcgagtgtgtggctgcgctgtaactaactgattaccctacagacttactggtcaatcaaactgatatttggttgaccagttttcgtttttttgcccacctgtacgtgccaacttccagtgctaatggtatagtttgagattaacgggggccgtaaaattgcccgttgtaggccggataaggcgttcacgccgcatccggcaaaaatttgattaaccgcacctaacggacacaacaccatgaaatctgccacctctgcgcaaagaccttaccaggaagtcggggcgatgatccgcgatctgatcataaagacgccgtacaatcctggcgaacggctgccgccggagcgtgaaattgcagaaatgcttgatgtcacgcggacggtggtacgtgaagcgctgatcatgctggagatcaaagggctggtggaagtacgccggggtgccggtatctatgttcttgataactcaggcagccagaacacagacagtccggatgccaacgtctgcaacgatgccggtccttttgagctgttacaggcgcggcagttattggagagcaacatcgccgagtttgccgctttgcaggctacccgcgaagatatcgtcaaaatgcgtcaggcattgcaactggaagagcgtgaactggcttccagtgcgccgggcagcagcgaaagcggtgacatgcagttccatctcgctattgccgaagcaacgcataacagcatgctggtggagctgttccgtcagtcctggcagtggcgggaaaacaatccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggaaaacgttaagcaacgtctgctggaattctcgaacgttgacgatatttattttgatggctatctgtttgattcatggccgctggataaagtcgacgcctgacttattataataagcgcaagggtaaacgttccttgcgctttcttaaattaagaagtcgcaatgagtattactttgtaaattgcagggtattgtttagctatctgtataacctgaatgttagtactcattcttcctggtagttatttaccaatataattccattcaccattttttaattcaaacagttctggaagagatgacggttgcagagtcatacgtttgagtggtgcattttcatcacccgggataactttatatcccatttttgcatggatctccgcggtaccgggataggcttctataccaattattgggtcattacccaactcaatattagcattaagtaatgcggcaagggcgaatccggaagaatttgctacccctgttaccgtcattatctgatcaatatagatatcaatccttggctgctcattggtccatctttttgcctgagaagctggaagggttgaaatatatcctatcgtggttccggcataaccaggaacattgcaaccagggcctaatgttatttcatgaactgtatagtcctcaacaggatcgaaagggctcttcataaataaatttagccgtaaaccttctgctaactctgtggtagcatgcgcctttttacatatgccaccatatatttcgtctaaagctgaggtgattttcaagttccgatagagcatacgtcctgttgttgtaataccatcggattctctgcatgctcctgtcacataattaaatggccaaggctctttactaatatcaagttttctaatttcgacaacgctttttccatcgtaattatggttattgccacgagtaagaggcggaagatagatgttttccgaatccatgcgtgcatattttaatttacgtgtaaactcactgtcgactattgggtgatgaaggaagtgagcatctgtaataatttgactctgaagggcattgcttaatggcatagacataatagttaccttttatgagtatttcactgatgtttagaaaaatagataaatttttctgtagtaaaaagagaagtaaacaaatgacatgcatgtttctgttgtagtgatatcaactctacacggtgatattaaagggtaggaaacactctaaagtatcaaaaaacgctcatttaaaattatttgcatgcaatttaaaagcatatcttattactaattggaatttgatgttgctatattgaggtctatattaataatgcctgtgaatggtatttttgatgtatttgatatgttatcaatttatattatttacaaactaattgtttcaaataatacatggctgattatgcggaaataaataatttcccaccggaattaagtagcagcggtgacaagtattttcatctacgtaactattcggaatattcagaatatactagcggtttttttttgagtttgatgatttttatcaaatcatgacttttttcctgaaaagtcagtagatattcataggcaagtaaggttttatactttgctgacaggattcaggcctgtctcagactgacatggatgtaatgaacaaaagggaatggctatggaaaatgagcatcaatacagtggtgcccggtgttcagggcaagccgcatatgttgctaaacgtcaggagtgcgcaaaatgatgcgacaatcacttcaggctgttttacctgaaatttcaggcaataaaacgtcatcgctgcgtaaatcggtatgcagcgatctcctcactctttttaattctcctcattcggcattaccgtcattacttgtttcaggcatgcccgagtggcaagtgcataacccgagcgacaaacatctccagagctggtattgccgtcagctgcgttctgcactgttatttcatgagccacggattgcggcgttgcaggttaatttgaaagaagcgtactgccacactctggcgatcagccttgagataatgctgtaccacgacgatgaaccgctaacgtttgatctggtctgggataatggcggttggcgcagtgcgacgctggagaatgtcagctaagcacaatctccagctcgcgcagttcacgccagaagcgttcggcaacgggattcatgcgggtattcatccggtatgcataggcctgaatcgggatcaccagttcgtcccgattcagtacaacgagcttcccgctgcgaatttcttgttggatggcgtactccggcagccaggcaatcccacagccgtcgagggcaacctgctttaaaagctcgctcatcgaagagacaaaaaaggtgctgaaacttaactcactgtggcgcgtcagggtgcgattaatcaatcgccccatgtaggagttgcggctgtaattcagtaacggaaagtgtggctgcgcgaggttaaaaagtgcttctccgtgttcgtcactggcgcagacagggaacaattgagattcaaataagcgaatgtggtcaaacggcgcttccagcaaatcttcgtcgtgaaaggaaaaaatacagtcactttgcccttcacgcagtttatcgaccgcttcatcgacatcaatagcttcaattgcccaggtaaagagcggcggcatctggctgataatggacggtaacagcccgagggaaagagagtgtgcagcggctatcttgatttttcgttgcgcgtaatcgctgccgccacgcagctctgccagattgctctctaactgttgcaacagatggcggatctgcgaatggaagattttcccttgttctgagagttgcagcggcgttacctggcggttaaacaattcaacaccaatcgcctgttccagcgcacggatgcggcggctgaatgccggttgcgagacgttgcgactgactgccgcctgggaaaaattgcggcatttttccagggtcagaaaatcataaagccatttggtttcaatattatgcaaaatcgcaccacagtcatccattacgttttactctgtcagccgcccttgcgggcattctacgtccattcgggcggctgacaaccgtttaagccgtttcaaacgttcctttcacgcaggctttgccgtctttgaccatcagtttgccgcgagcgtatacctgctcaatgcgcagttctggcgtcatgaccagcaagtcagcatcattgcctggcagaatttcgcctttcccggtcaggttaaggaaaccggctacgctactggtgagcgggcgcagggcatcgctgatactgaaatcatagtctttgaccagcacctgcacggtttccagcaacgtttcaaaaccggcaacaccgatatgggttaaattcccttcgtcatcgaagaacggctggctaccgttgccgtcggagctgagggtgacgcgtgccagcggaatacccgcctgaacggcgcgggcaataccttcggcaggggcgaccggttcgtcaatgctgctggtgatatcgatggtgccgcctttgcgcgcgaactccagcgcctgctcaaacaacggtacgttgcggttaacgtgggtcggcagcagcttgctgatcggcacatcgcagttttccagcaggtcataaataggctgtaacgcctttttactgtcgcccatgtggaacacggtgacgccaggtttaccgccgagcaaaccgccaacgcgggattctgccgccatattggccaggtgataaacgtccggtgcggcagaacggtgatcagagatggcgcatttcacgccaatcacacgatcgataatcgccacgtctttttccacggaacccgtaatggtgcgggaagggacatgataagcgccggtcagcatccaggcgctgatgccttcttcattgagcgcacgggtcttggcgagcagggattccgggtggcgagagatagagtcggtgcccagcagaccaaccactgacgtgacgcccgcttccgtcaggcgacttagcgccacttccggcgtgcgcgtcgtgggacctgcttcgccgccaccgccaatcaaatggacgtgttgatcaataaaacctgggcagaggatctgcccactgagatcgacaaccgtgcagttcggtacaatgtcagaagggatattgctggcaacggcgataattttgccgttagcgacgaggacatcgcaaattccccgatcttccggcgcatacaaatgcgctccctgcagcagggtaaaaccggctgcggtataatcaatcatggtaactccttgttaaacaataagctgcataacccagatcgacagcaatgcgttaatcacgcagaccgtaatgatatgcgggtaatatttggcattcacttcggctgtccccaggcagcgaccgacattttgcaccgggttgcccattaaatacatcgcgggcagtaaaacggtgacatcgtgaccggttaatgcgccagcggttgccagactggcggcaacaccgactgcgccacccatactcattaatgcggctaaaaggacggttgccgcttcaccgggtaatccccacagcgccattacgggttcacagatatgccccacccagtcgagcaggccggtaattttcagcgcctgaatgatgacaaacgccatcaccacgtttggcagcaggttggtcgtggcgatagtaaagccacggcgcgcgccatcgataaacatatccatgacgtttttgcggacctgagttgtcatgcttgcgctccttgcgttgggttgcgacgttcttcgaagttaagccagacgcgcaaaatgttggctccgacaaatttaaacaccaggatgacggctaaaggtacgattacggacgtgcccagaaaggcaaacaccgcgacgccggaagagaagtagttggtgatgatggcgctaccgctggtttgatatgcggcgaaaatcactttatcgcgttcggtaatttcaccttcctgcgccagctctttggtcataccggcggcggcatcggtgttttgcaggttagcgatcagcgccagcgagcagatccctggaatgcccaacaacggttttagcacaggtgtcattaactgctgcgcggcgcgtaatccaccaagaccatcggtaattgaaataatccccagagagagaatgactgacggtgccagctccagcgcaaagagaaagccatctttagcccccgcgccacccgcgccgcgaaatgaggtggtggctccgttcgcaccaggcagttgcccaaacgatccgttcagaacggaaaaatcaaaaacgcgccaccagctgtctgttccggaaaaaacaccggaaaaaaagattatggtgagaaaaaaggccagataccctttaatgcccactttttctgtcgccagctccccggctacagcatccccttgttgtgtcataacaatccccattgtttttttgtgtttgtgtgttgcttgagccaggaaaattcctggaactgaaaaaccttatcagccatgtgggtatggggaaaatgcaagtatgtttctggctatgcgttttttgcatagcggaaaaattacgctgtgtggaaaaggctctgcgcaggattgagttgcagaaaattcataaaccaagtgacaatgacatcagtaaataaaaacagaaaatccagggacgaaaacgagatggcaaagtacaacgaaaaagagctggcggatacgagcaagtttttaagttttgtcctccgacacaaaccggaggcgattggtatcgtactggaccgtgaaggatgggcggatatcgataagctcatactttgtgcccaaaaagcgggcaagcggttaacccgtgcattgctggatactgtggttgccaccagcgataaaaagcgttttagttattccagtgatggtaggtgcatccgcgcggttcaggggcattcgacttcgcaggtcgctatttcctttgccgaaaaaacaccgccacagtttctctaccacggtacggcaagccgtttccttgacgagataaaaaaacaggggctgattgcaggtgagcgtcactacgtacatctctctgctgatgaagcaacggcacgcaaagtgggagcaagacacggatcgccggttattttaaccgtcaaagcacaggaaatggcgaaacgaggcctccctttctggcaagcggaaaacggggtctggctgacatcaacggttgcggttgagtttcttgagtggtaagggaaacttccctcatgaagtgaccacttgtagcttaaataattgcactgtgctgataagcgcagcaataaacaacgccgccgcgccgcagagagtggcgctggcaagcgccgatgttccattgctgagcatactggtcagcgccgggccgaggatttgcccaatgccgtaaatgagcgtcacaaagcctaaaagattgagatttcccggtacgctcagttggcgggcgatagtcatcaccagagatgtcgtgcccataaaggtaccgccaaaaccaagactgctgatgataagcaagagaggcgagtcgctggcgagagtaagcagcacacagatagcctgcaccagcaaattcgccgtcaggcagggcaaagccccccaacgttttgctgcccatagccagccaaagcaaccaggcacaattgataagccgactaacgtccagagatgggcggttaacaatggtgagcctgcatctttcgccatgagcggcaggtaagtcgcgacgatgatataaccaaatcccgccaggccgtacagaatagccagtaaccaccagctcattatctgttgctccgtttttgccaatggcattggtgtgatggcgtgttttttcgagggcattaaaagcgtaagtgcaatcagcatcatgccagaaagcgccccggcgccttgccataacgtttgcgaggagaggtcaaaatgcaggcctgccagaacatattcattgcccagtgcgatgccaatgccaacgccagaaaacaaagctgccagcacaaaaggatggcgcgtgtgctgcataatcagcgtcgaaccaaaaatcagcataccggcgctggcgacacccgccaggacgcgaatcaataacaccagaataaatggcggcaaccatgccattgcgaggatcaacaacccgctcgccagggcagaagccaacagaaatgggcgcaggcgcgatggctggtgaaatgcgccaaaagaaaatagcagactgccagccagataccccgcatagttgccgctggcaatccacgagagctggctaaatgaaaacgatccttccgccatcatgacgggcaacataggcgtataaaggaagcggcctaaacccatacctaaggtcagaaccagcatcccgaaaagcgcggtgctgaaagaaaagcgttctacgggatgcgtggacgaaggcatgtttaaccttgtttgtcatttttgttgttaacaagttaataacaaaaaggtgaagcatgccagcctgttaatgcgatgattgaggggtaaagcgataaaaacgatttggttcgctaacgatataaatattaccagaggcatccatcgcaaccccttcggcctgtttgatgttatgcgacaaacctcgactgcctttggttagtgacatttcaccgataacctcgccaaccagggttacttcctggagtgcgcgagattcatgagacagcaccagaagcgtatttttttgctggttaaattctgcgccggacacatcatctaaagtaaattgccgttgtagtgcctcgtctttgctgatgtgtaattcattgctacttaacagcccgttaactttgtagacctcaatcggatttttctctttaaaaaaccagaaagtgtgatcctggcgagaataagccaacccttcaaaaccgcaattggttggggagtcttgcagcgggatttttatttttttgaggatttttacttccgagtttggggtcagtgaaatcacataaatggcgtaatcgcgctcatcgctaatgacaaactgattatcgccaatgtattcgatcgtctcgagatccttaacaaaatccagaggaattgtgcggataaaatcaccattggtggtcatttcaacaatggcggcaggtttgttgatagtgctaaaaagagtattgctttgtgccgaccaggtcagcgaagagatattattcgttatgcctgcaatttctttgccgtcaatggtggcgtggtaattctgaaatgatgctgcatgattgcttttacgggcgcaagattgcacgaagaaagtacacactgccacaatggcaaaaagaatcacaataatggagatgcgtttacttaacgaaatactttttgtcacggtaatccctttaaggcaaatcaataagatatcgagaagtatacgtagcgaccttaatgaatccttaacgcggagaaaccccgtaatgtgcaatgcagcgccagacaccatcctgctggcaataaattgactcagtcagcccagggatcacccattgtatttcctcgccggggggacaggtcagccaaatgcataacccgcagccgccgcgtaaatcacggggaatatcgctgacgcgaaaagtcatgcccgctgcctgcaacgctttgcgggtttgtatgacgccgaccgtggagtgaaataaaaataaaaactctttcatcggcgtgtcctcactcgttgaccaattaccgccgcgccaattgcgccagcaaattgcgcatcaggatgggtatttaccggcattcgcaggtgagattccagcatccgggcaaacttctggcaatgactaacgccaccagtaaacagaatcggcgcttcacaggagagacgagcaatgaaattggcactcctccgcgccatcgcgttaatcactcctgcgagaatcgcttctggcgcgacgcccgctgagcgcaggctgatcgcttctgattcagcaaacactgtgcacatactcgtgatggcgtgcggcgtgacattttcggtaatgctgtcgagttgctcgacgctggtgccaagcgtgcgcgagatcacctccaggaaacgcccggtgcccgccgcgcatttgtcattcatcaggaaatcgcacaggttaccgtcatcatcaagctgaatcactttgctgtcctgaccaccgatgtcgattaccgcgcgcgttgctggcgcaagaaaccgtgcgcccagcccgtgacaggagatttccgttacctgtttatcggcaaaatccaccagttgccgcccgtagccggtgagcgtcagaaacggcgttgtctctaacccttcgcgcagagtttcccaggcttcagtaattgctgttgccgggcgaaagggggttggaacgaggaaacggcgcgtaatcacgccgtctgccagtaagatccctttggtggcggttgagccggaatcaatgccaatcgaatatgccactgccactccttacagcatctcaataaaggccgcgacacgggtactgagctgcccgacatccgaggtggagtagtctgtttcaatagcgatataaggaatgttgtgctgctggcgcacatgacgtttaatcgccagcgattccaccgcgtaggtatggcacgcctgcaaaatcacatcaactacgccatcgacctgatattcctccaccatctggctgagcattttcaggcgctgatcgttcggcgaaacacaggagcagccaatcgccagatatttatccgccagcgcgtcgtagacatcgcccgtttctgccacgcattgctcggtcgctttcgccccggtgcagttttcataaccgacaacccagccgccattctcttcaatcgcgcgcaccactttttctgctgcgccgccaatcgggcagccggtgattaaaatgcgcggacgcgggtccagtcgctggccttcttcccactgctgacgaacgcgggcggtcattgcatccagttcattgatcaacgcctctttatcgaaccggaaggttgcgccgtaaaccactttcagaatgtcgctgccgctaagcgccggaggatttaactgcccaagatgataaaaattagccagtgcgcgacgttcgcggtttttcagcgcaatggcatcgcgcagagcatcttcgctaatctcgtgcccaaaacgttcttctaccgttttttgcaagcgcagcatctcggctttccataacgcacgcgaggcatcgtccttaacgctgttgggcaattgcatcacatgaacaggcttaaactccgccatgtattcatacattttctttttgccgtcgcaggtggtttcaccgaccaccagatccgaaaagtagaagtaggggcatttatcggttttgccgaagccgtagctgcttttaatcagcgggcagaggttgcgcggcagatctttctccgcttcttcaatggtttcatcagaggtggaacagagcgaaaccacaaccgcaccggctgccatcgggatctcttgcggcataaaggtgcagtaagtgccaaccagcggaatgccgcgctccttgagatccatgacggtgagaaagcctgtctggcgagcttcagagaactgatcgaaaatggcgggtagatcggtgacaagtgacatgattttccttccccgtaccacgggagataatgaaaagaggccacattattaccattcttttagtatggtttatttgatctctctcgcggttagccacttagtttttcatggatttctaaaaattgccgagggggaacaaggccgggagctgcgacagcaaatataaaattagcccaatacaaccgccaaccagcgtaccgttgacacgaataaactgcagatctttgccgatatttaactctatttgccgcgacatatcccgcgcatcccagctttttaccgtatcgctgatgtggcgcgtcaggaatgcggaaaactcaggcgcgacgcggtgcgcggcttgttcaagatgaccatttaacgacgcccgcaaggcatcatcggcaattaacgtttcgccaaaccattgacccgctcgtgcgatgcgttctttcacacgagaatcttcactgttgatatccactttcagccattcccgtaaatccccccacaattcactgagatagcgattaaaagcttcatcttctttcagatagctttttacggcatcggctcgcgctgccatttccggatcgtttttcagcttgtcgatcagggcgaaggtggcgcgatcaaacgcatggcggatctgatgcgcacgatcgcgactaatatcatcaagcaaagaattcaccgcgtcagaaaccaactccgcgctatgttcgcccaaccattcggtggggagaattttggctttcagtggatgctcgctctccagccagcgaacaatttgctgggcgataaacttgcgcgatttatcgcgctggagaagggcgatcaactgtgcgatcagcgtatccagcagcacctgatgacgatcgtttttggtcatactctccagcatcaacgcactggtgccggaaagatcgaccttatcaatcgcccgatggaccgcgcgcttaagcaggcgctgaatacgcgcatcatcggtaagttcgagaaaaccgctcatgatctgcaacagatgctgaccaacgcggcgggcgttttctggctggctaaaccagttgccaatcagcaacgccggttcgtggcgtcgaatcaatgccaccagggattgagtatcaagaaatttttcctgcacgaactggccgagattttcgccaatccggtctttattacgcgggataatcgccgtatggcgagaaatgatcggaatcggcacgcggcgaaacagcgccaccaccgcaaaccagtccgccagcgcgccgaccatcgccgcttcagcaatcgccttcacgccgctcacccaaaaattgggcggcaaaaacagcgtaacgacaaaggtagcagcggcgataagcagtaaagagagcgccaaccttttggcgcgtctgagttcgatgagtttattcataacgttaagaatagagcctgacggccggatcgcgcaaaaatcactgctcctccactagctcggctgcctgatgctggcgcacgcgattgagcaatcccgccagggtgaaaacgacgataacgcccgccacaacggctaacagatgaaacggcaagcgaccgccgttaaaccatagccagcggccgatttcgaccgagaccgacatcaccatcaggatcaccatatttagcgatgcggagacggtccctttcggtaacttattggaaaacagcgtaaagcggaataaggtcgggaaaatcaaaccaatcccgaaagcatacagactggtgcccagcaccgaccacagccagacgtgcggcgacagcagattgccgacaatcaacagcgagaggccgaccagttgaatgggtacggcacgccagataaaccgcggttcggtcggatctttaacaaaacgcgccacgatggcattcgcaacaatcaccgcgccgaacaccggaacctgtgtccaggcgaactgcgaagttgttaagctgcctgcatcgataaggatcaccggcgagacagccacccagctcatcatcgggatatagcttaaagagatggttgctgcgccaaagaggaacagccgattgcaaaagacattacgaaaatcgcgcaagacgcttttggcgctaaacggaaccgcgccgcgcttcaccgtctctggcatcgccaacagtaagccaacaaatgagataaaacccataaccgcaatgatggcaaaaaggactttccagtgcataaagtgcatcagagctgcgccggaaagcgggccgataatcggcgcaatcagtacgatggaggtgataatcgccatcaacttgatcccttttgtctgtccgaacgcctcctgcaccgtgacataaccaacggtggcaataaaacagatactggtgccctgaattgcacgcgcgataagaaactgtgtcatagacgttgtgaacattgtcgcggcgcaggcaagggtaaaaattagcgccccggtaatcagcaccggcctgcggccaattctgtcggaaagcggccccagcagccactgtaacgccataccgccagcaagatagagactgacggcagcaggggccagactgacatcggcattaaaatcacgtaccacattaatgatcccaggctggatcagatccgtcgacagatacgcagcaaagtcatacaaaatcaacgccatcgggaaaaacagcgtggcggcatggcgggtaaaaaaacgtggcataacaaacaactccttgtccggagaaccccaacggggaaaacgaaattcaataccgtcggtaatgacgaaaggcaggtgagaagggcaacgagactgcaaatgtactgaatttcatgtaatcaaccacactgcctgtgaacacacagacagagaaatactttctgacttcgggtcagaatgtataacgattacaaatagtcatcagcacattacacctcttgaattgatgggttgcatagaaaatatacaccttaagtgtaattaaaatttgcggttaatcaaaagagcgcggtggaaaggggaatatctgccgggtacaggacatgtaaaacgcgagcttgtttccggaaaaatgtatcgtttgcagaagaataaaaatagcctggaaagcgcctcggggaatgggaaattgccgggtgagaatggttttgttagtcgctaaagtcaggccatctttttcaacaggtgatggatcgccatgacaaacttcacgaccagcacgccgcatgatgcattatttaaaacctttctcacgcaccctgacactgcgcgggattttatggagattcacttacctaaagatttacgtgaactgtgcgatctcgatagcttaaaactggaatccgccagctttgtcgatgaaaaattgcgggcgctacactccgatattttatggtcggtaaagacccgcgaaggcgatggctatatctatgtggtgattgaacatcagagccgcgaggacattcatatggcctttcgcctgatgcgctattccatggcggtgatgtagcgccatatagagcatgataaacgccagccgctaccgttggtcatcccgatgctattttatcacggtagccgtagtccttacccctggtccctgtgctggctggacgaatttgccgacccgactaccgcacggaagctttataacgccgcgttcccgctggtggatgttactgtcgtgccagacgacgagattgtgcagcatcgcagagtcgccctgttggagttgatccaaaagcatattcgccagcgcgatctgatggggcttatcgatcaactggtagtattactggttacagagtgtgctaatgacagccagataactgcgctgttaaattacattttactgactggcgatgaagcgcgttttaatgagtttatcagtgaacttacccgtcgaatgccacaacacagggagcgaataatgacgattgcagagcgaattcataatgatggatatataaaaggggagcagcgcattcttcgattgttgttgcagaatggggcggatcctgaatggatacaaaagattaccggactttcggcagagcaaatgcaggcattaaggcagcccttgcctgagcgtgagcgctattcatggctcaagagctaatcagagacggatgacaaacgcaaagcagcctgatgcgctatgcttatcaggtctacataacccattaaatatattgaactttaaagatttttgtagacctggtcaggcgttcacatggcatccggcatgaacaaagcgtactttgcttaattcaggctggaacgtggcgatgacccagcaaagataaaacgagtcacaggttatgcatgagaggaaatcaggcgcttcgccgctatttcgaatttattccattgcccgatacacggcctcgccaatttgcttcagtgcttcgcgataggtttcgctgagcggcaaagcgcagttgatgcgcagacaattacggtatttgccggaagctgagaaaatcgagcctgccgccacctggattttcatgcggcacagctgccgcgcgacgcagaccatatcgacctgttcaggcaattctatccacagtaaaaatccgcctttcgggcgcgtaatacagatttcgcagggaaaatattcccgtatccagcaggtataaagcgccaaattgcgctgatagatctgccgcatccgccggatatggcgatgatagtgaccttccagcacaaacgttgccgccgccatttgcgtggacggcacattaaagctgctgatggcgtatttcatatgcatcagtttatcgtgataacgccccggtgcgacccaacccacgcgcaggcctggtgcaatacttttactgaacgagctgcacaacagcactcgcccgtcgatatcccaggaatgaatggtccgcgggcgcggatactccgtcgccagttcgccatagacatcatcttcaaaaatcacaatatcatgacgctgagcgagagagagaacggcccgtttgcgcgcgtccggcataataaatcccagcggattattacagtttggcaccagaatgatgcctttaatcggccactgttccagcgccagttccagcgcttcaacgctgatgccagtttctggatcggttgggatttcaatcactttcacgcccatgccgcgcagcatctgcatcgaaccgtaataacagggggattcgaccgcgacaatatcgcccggtttacacactgccattaacgccagcgacatcgagttatggcagccgctggtgatgatgatgtcatcggcggtgaccaccgagccgctgtcgagcatcaggcgggcaatctgctctcgcaatactcgctgaccggctaacaagtcataaccgagaacggtttgcagattatgctgcaccacccggcttagctcccgccacagcggtttcaggctgggcgcttcgacatccggtgtgcttttgcttaacggaacaatggaactgtcgctatgcgcctccagcatatccagcacctgatcccactgggtaatttccaccgggcgctgcaccggacgcgtcatcggcggtactggcggctgggctttacgttgtgcgacaaaataacccgaacgcggctgcggagtgatgagcttcatcgtctccagcgtctgatacgcctgctgcacggtgctgatactgacgccgtgctcctgacttaagctgcgcaccgacggcaatttctccccgtgacgatacagcccttgctcaatccgttcggcaagcagagtcgccagatgttgataacgcgtcatgctgtattccttatgtggaccatacagagagaaaaaccggtacagatgaggctaaaaaaccggatgcagatgctgttttaacctgtctgtatgttaaataaaagtaatatttgaatctgtattgtgaactgccagaaggtggatgatgaagcctctgaaagatgaggaggtagcagatggaatttcacgaaaacagagctaaagcgccgtttatcggcctggtgcaactctggcaggcggtgaggcgttggcggcggcaaatgcagacccgacgcgtgttacagcagatgagtgatgagcggttgaaggatatcgggttacgcagggaggatgtggagtgaggggggatatagatttatatataataaaacgtttttatgtttttaaattaagttataaaaattttcccgagacaattcatcaataggtatggagtgtacaggaatatcttcttcactaacctctttaaactcatgtcgataacggtcaaaaaacgcacagtgattacttgtgttttttgactgactttacaactctcattattcgctattgtgcagtttctctaattgttttataccctggaaagttaaatgtcagctactgaatactttttgattgtttgagatttattttcatttgaaattataaaatcaggtgataaatgagttgtgattaatagatggttgatatcatttttatctaaaattgatttatagtatcgacctgaaaaaatagttgttgccgcctgagtaactatacaatattctgaaaggttttctttcaaattagaaatgttgtggggttttgtttttgtatcttttatctctaaggagcttgctttgggtcaatcagaatacatttcatgggtaaaatgtacttcctggctaagtaactttgtgaatcttagagggttgagacaaccggatggccgtcctctttatgaatatcatgcaaccaatgatgaatatacccaattaacgcagctactccgtgcagtcggtcaatcacaatctaatatatgtaatagggactttgctgcctgttttgttcttttttgctctgagtggtaccgcagggattatgaacggcaatgcggatggacgtgggaccctatatataaaaaaatagggatttcattcaccgccacagagcttggtactatcgtaccgaaagggatggaagattactggctgcgcccaattcgattttatgaatctgaacgacgcaattttctcggaacattattcagtgaaggtggtttacctttccggctactcaaagaatcagacagtcgctttctggctgttttctccaggatccttggacaatatgagcaagcaaagcagtcaggtttttctgccctttcgctggcaagagctgtcatagaaaaatcagcgctgccaactgtttttagcgaagatacctctgtagaacttatcagtcatatggctgataacctcaattccttagtacttactcacaacctaataaatcacaaagaaccagtacaacagcttgagaaggttcaccctacctggcgaagcgagtttccaataccgttagatgatgaaacaggaacgcattttttgaatggactgctatgcgcagcctctgtagaggctaagcctcgactacaaaaaaataagagtacgcgttgccaattctattggtcagaaaagcatccagatgagcttagggtgatagtatctcttccggacgaagtttcctttcctgtaacaagcgagccgtcaactacgcgctttgaacttgccatttgtgaagatggtgaggaagtctctggccttgggccagcctatgcttctctggaaaacagacaggcaacagttcgattacgtaaaagcgaagtgagatttggcaggcaaaatccatcggcaggtttgtcgttagtggctcgtgctggagggatgattgttgggagcattaaacttgatgacagtgaaattgccattggtgaggtgccgttaaccttcatcgttgatgcagatcaatggctgttacagggacaggcttcttgcagtgtgcgaagcagcgatgttctgattgtgctccctcgggataatagcaatgttgctggttttgatggccaatcgagggcagtaaacgtattaggactaaaagcactacctgtgaagggatgtcaggacgttacagttacagcaaatgaaacttatcggattcgcaccggaagagaacaaatcagcatcggaaggtttgctctaaatggaaagcgtgcaagctgggtttgtcatccagatgaaacatttattggtgtaccaaaagtcatttctacactaccggatattcaaagcattgatgtaacgcgttacacgtgctgacaaaacagcattacagccagcaggaagtactgcgttggatcgatgtctgttcagggactcaacctaatgcaaaggatcccgcatttcttaaagtcagggcgcatatcttccagcgtaatacctagggaatatgggcttgtgttgataaagattgcagattaaagcacggtacaccgctcgacaaaggctggccctttggctatgtgtatgtgaaccagcgacaaaattgtgactgtggaagccctgtatacgaagttgcattctgtaatgattgtaatgagcctcatcttctggcacgggacaaaaagggcaaactagtccagtgggaaaataaaggtggcgatgaattctctttgcaggatgaagtacctgttgaacatgacgctacagaagaaaaagtcgaaaaagagaacagttttcagcctccgttgattattgccgcaggagagaccagcgaggcaggttataccctacaacgcctcgaccgtcagacgcgccgtattggcgttattaacaatgacagcattccgctgattattaatgatattgaacaggtttgtagtgccagtggctgtggctacagaggcatgagtgggaaacagcccttccggcgtgcactattaggtgggccattttacgttactaatatcgtgcccaccgttctagagtattgtcaggactttaccagtgatgaaggcaaagagggcgtcggaccagattcgttgccaggacgaggtcgtcgactcatcacctttacagacagtcgacaagggacagcccgaatggcggtgcgtatgcagcaagaagcagaacgcagtcgcttacgcggaagcgtagtcgaaattctcagctggcatcaaaggacgcaaacgtctacagcgccgaatgccaatgccgatctggaaaaattagcggccagggcgaagcaagcccgtgagcaggcagaagaatatcgaagctggggaatgccagaccaggcgaaattgtcacaagcacaggctgaacagcttgaacaggcttatcaggctgcaaccggtgggaaagccgcgactatcctggtatcccgaacctggacggagatggttaacgagcttaaagagagagccgatatccgcgggccggttctgcaatataaccattatcttaagcctgaagtgtttaatgaaaacggcggcccccttaagctttctgaaatgttgttgttccgggaattcatgcgtcgccctaaacggactaacagcctggaaacacaggggctggttcaggttggttaccaggggctggagaaaatacataagagccccttgcactggcaggaaaaaggattaacgctggatgactggcgcgattttctcaaggttacgttggatcattacgttcgcgagagcaacttcacacagctggatgatgagctgaaaaactggattggtagccgtttttcatcaaaattcgtccgtaacccggaatcaaaagatcctgaagataatcagaacagacgctggcctcaaattcgtaatggcaacgtatcccatcgtttagcgaagttgctgatgctgggggctggattcaaaaccgtcaatgcggcaactattgatattatcaatacatggctgaaagaagcatgggcccaacttaccggaccgcttgcagtactgaaacccgatggcaaccgtttttatttaccgaaagagcatatgactttttctttaatcacggatgcctggatttgcccggtaaccaataaaatcctggatacggcttttaaaggcttaaccccttatctgcctacccatatttcgttcgagcatcttaccctggcgcaatatgacacttttgtcgcgcagaaagtcacaatgccggaaatctggaagctggatcgttcacaggaagactacgcagagggtctggcaaaagcacgcgactgggtcagccatgatccgctgatcgcacaattgcggtcggaaaacgtctggacagacattaacgatcgtgtcgtggaaggcggcttctactatcgtactgccgagcactctgcccagcagtcgtcagaacgtctgcaaagctatgaaaagatgttcaagaatgggcaactaaatgttctcaactgttccaccaccatggaaatgggggttgataccgatcgcgtgatgacgctggcctctcgcagccagcaggcaacgattccggggccggagtggcacctgaatgacgaactggtggtgcgtagtctcggttataaaacggtagaactgaacgagtttattctgccggctaaagccaccaacgctgtcgagcgggtcaaagacattcagatccacaaacagttgaatggaccactgtcgcagtttgggcaacgcttctgggacgtgctgtttaacgaccatgaagaagcgcagtcactgatgaataacacgcgaattaccggcgttcactataccgatcgctatctgcaaaacccggttgcgctggcgttgttgggatcaattctgagaccgctaaaaacaaagctgaccgatggcgctgaagtgacgctggatacgctatttaaagataaagatcgccccggtaaccggcctttccatgactggatgagcatagcggattttcaggatttcgctgatcagtggtttgctgctgcgctgggcaggccggtagaactgacggtgttcgactcgccgcgcgatatccctcaccatcgtaaactgacggtgacttttgaggatggtcaggtattgaagatccgcttcgatcaggggatgggctactggcgcatcaacttttcatcgcaatggcattactttgatttccgcgatgacgtttctttccagttagtcaaaatggctcaggcctgcaaggaagggaatgtcgccaacagcgaagagagttgggcaacggatgtgctggtggaggtgatcgcctcctgatgatgagccgctcccgatgtggtgtcgggagcggtattttctataaaacttaccgcttatttgagatattcatcgaaaatgtcgagtaattcttgatgtatacacggccattcctgacctaaattgacggtacacaagccaatatcgaagccattaattttataacgatgtttcactgcggtatctacgtggggatatattaataacccccctatgttttcgccattttcaggctttaacgaccataagtaattcatcagttgataaagattttgcgaatgaaatttttctgttcccattcgtcgtgaaaaaatgctcttatagtatttggcgtcaacgataagtattttttctgatgagcgaatggtgatgtcagtttccattcgaggtaacaaattaagtgactgatccgatatactcgatgcatcccattttaaataagagcgggttgtgtttgcagacgttaattcacgacggcaaaattcataaagaaacttttgataaagtaatgacatctctttttcgtttctttcaaaatcatagaaacggtagtgtcctttgttttgacctggaatagaattattgacgatgaatttgcagacactgataacgaatttataataacgcgtattttttccgccattcagatagctgaaatgctgcggagttaaatgaagagtgctaatgcccggtaattttctataaagtgaacgagcttcatctctgatagttgaatttaacttttcatgcttaattaatatggctaatgtgctttttataattcggttagccagcgtgtcttcattaagcatatcaaaagtactgacggttttcccatgattaagatggaagccgcgtattgttttagcaaactctattcgccctttgatgccaggaatgatctcggtgttaggattgtaatcaagctcaagccctcggcgtgaaagctgtaaaacccctttatttaatacataccccaggatatcaagaagattgttaccgggtatggcttcaaggtttgcctgcttaatttcctgtaaataaccccatgcataggtaagcatgtaatagatattacggacaggtatcacgggctgttccactatgagtcccctaataatttgttggtccatttctgttgtttataggggtcatcaaagaaatattcttcgagtaaaggggcgatatccgtcatcacaatttcattaagccattgcgtatccggagaggtgccatcttccaacccacagcagaagtaactatgcccaatgcggaatcctttcccaaggatagtggcctctttgctgatttcctggttcaactcgttcattttttggcataaagactcaacaaatgaaggttctgcttttttattcagtaaaaaattccggaactgtggtgtatcaaaacctggctcaatatctatgaaagaaaatcgtctgcgtagggcatagtcaacaacggccagagagcgatcggcagtattcattaaaccgatgatataaacattctccgggacatagaatcgttcttcatcgttttcggagtaggttaggggaacagaccagttttcacctcgtttatcatgttccattaacatcatcacttcgccaaatactttactgagattggcacgattgatttcatctataataaaaatatactttttctctggctgctctttagcttgctgacaaaaattgtaaaatatgccgtctttacgtcggaagccgacgccattcggacgatagccctgtataaaatcctcatagctataagattgatggaactgaaccatattgacgcgttgcggagccttttctcctgtcagcaagtaagccagacggcgtgcaacaaaggtttttccaacgccgggcggcccctggaggataatattttttttgatggttaatcgtttgagtatcgtctctattgtggtttcagggataaacaaatcatttaacgcatcttccagacagtatgattcagtttttgacataggtggaataacactcttgccagaattaaatattaatttatagtcgttgattatgttgtccagcatagaggcaaatcgggtgtaatcaataccctgtgagactttttgggaacaggcgtaataggactgtccgtattttttaggatatacacccgaagttgcctgaaaatactctgcgattgttttaggtatgtctgaagagaactgccattgggcatgtggttcattcgtgtcgcttataccataagccaaaaccaactcatcaaaatctttataatagagaataacgggatatataccgttagaagcttcctgaccttctccaagaaatgcaaaccagggaatagacgtaaaattaccataaccgaaactcaattttactcgcaggttacggtaagacgttggataatctttagtggattgcgaacgttgttgctgtgcttgcttaataaatttttcaatccagggttgaatagattccataagatatgccttcctcattgctaagcctctattatcgctttcgcaacgtactgaaacaatagatttttactgcaaaatcagactggtaaatatttactgagggggaaagtttctattgagtcagtggaaggctcccggtggttaaccgggagtaaacgctgttacgcgactttctgtttaccggcaatcactccaataaacgcctgcacctgcttttgtttacgcgccgacagtttgcacacctggcgtagcgactgcatcagttcgctctcctcggcggcgggtggttgggcggtgaggacaatacagccttccatcactttgacatctaccgccgtgccagtggcaaaaccggcggcttccagccactgacctttcagggtgatggcgggaatacggctgtaatccgggtagcgactcgcataaccgacggtgacatgacggttatttgccggggagacttctgcttcgaacggttgtgcaatagaatgcgtgtcagtcataactgctattctccaggaatagtgattgtgattagcgatgcgggtgtgttggcgcacatccgcaccgcgctaaatacctgtatatatcatcagtaaatatggggaaagtccagctaaaaatagaataaaatgggcaatttctggaatgatttaaatatatttatgtgggttatgattggcgtgaaataataaaaagcgcaccggaaaggtgcgccagaaaataatgttcaggattttttacgtgaggcttttttacccccgctagctgcgcgttcagctttgattttttccagcaacgcggcggcgctgttttctccgctgatcaaatccgggttttcggcccgccactgggcggtaagttcaccacggaacgcttttgccaggatggattgcgtcaggttgttgacgcgggctaaggcgttgttgacctgtttttctatggtgtcggcgtaggcgaagagttgctcgacgcggcgaacgatttcggcttgttcttttactggaggtaataaaacaacttgggatttgatatcttttcctgaaatacctttttgaccagaagttgttttcacgcagttcatcattgcatttcgtgctgagggggatgaaaaaaatatttcgatatattctggtaaagcatctttggttaatcgagctcgaataagtttatcaggatatagcaaattttgatgttgtaattttttcaataacccacaaacaccaacaaattctaaacttccgttatagcgagtaaataaaagatctccatcttgtaatttgtggcggtttagttcactttctgaacattctagaaaccgaatatcgttttgatctacatggccagcacgtacagaactaatgcgtagtattggatgaccaacaccactttcatttggctttgatgaaagaccattacgtaattcagttaagatagattcaaaatttaacttcttaaatacagaatgttgcggctcaaaattacgccatttttctgtcaattttccattaactgcgccccccaataccgcttgacgaaaacgtttcaggatttgtgggatttgctcaaaacgtgctttggtgctgtctacctgcgccagcagcgtatcgagtttttcagcgatgattttttgttcggcaagtggtgggattggtatatttatcaaatcaaagcttgccggcttaatattattaatatttgcaccagcagaaagtgatgaaattttgtttcgataaagagaagattttgtgaaatgagcaataaaaccagaaaatataagtttttcaggacgtaatacaccgcaaaatgcgccgaaactacattcaaatggtagatgctgatgtgcggatttaccaactacggatttgctccctgatgacattgcaataacaatatcttcaggagatattttttgactttctttaacaagatttttaggaacaaaaaccaagtccgtagtatcaaacttgccattctgaatattgttcgcacggataagaggcaaataatcatcttttagataatttattgcctgctcttttttatacgttactcctcggattagagttgtgaccgtagatactggggcgataacccacccctccggcaatttccccgcactcattccttcaccccaccaaacgcttcttccagcaactgacgctgcaaatcggcctcatcgctcgcccccagttcacgcatcagcgcatccagttcagacagcgcctgtaccagttcgcccatcgcttctgccgctaatacatccggctccggcaggctgtcggcatcaatactgtctttatctttcagccaggagatatccagcgaatcggattttgcggtgcggatccactcacggctgaacttgcgccagcggctggtagcaagatgctggtcggtgtttttgttctcttcgctgtcggcaacttccgtctcttcggcgttaaaactccattcaccttcagtgcgcgggcttaaaccgtgcgggtcttcgccatacacgcgctcaaacggctgcaaatgctcgtcggtaaacggtgtgcgcttgccgaaactcggcatattggtacgcaggtcatacacccacacatcatcggtacagttcttatcctgattcgggttcgccaccgtccctttggtaaagaacagcacgttggtcttcacgccctgagcgtaaaaaataccggtcggcagacgcagaatggtgtgcagatgacacttatccatcaggtcacgacgaatgtcggtgcctttgccgccttcaaacagcacgttatccggcaccaccaccgccgcacgaccgccgggatgcagcgtttcgataatatgctgcataaagcacaactgtttgttgctggtcgggtgaacaaaggtgcgggtaatgttggtgcctgcggcgctgccaaacggcgggttagtggcgacaatatgcgccttcggcaggttttcaccgtcgctacccagagtgttgcccagacggattgcgccgccgtggtcgaggttgccttcaatatcgtgcagcaggcagttcatcagtgccagacgacgggtgccgggcaccagttcgaggccgataaacgcgcggtggatctggaaatcctgcgtgtcgccatcaaggtcgtccagatcattggtttgcgacttaacatagcggtcggcttcaatcaaaaagcccgccgtacctgccgccgggtcctgcaccacttcacgcggctgcggtttcagcagatgaataatggttttaatcagcggacgcggggtgaagtactggcctgcaccagacttggtttcattcgcgttcttctgcaacagcccttcgtacatatcgccgaagtcatcgcgcgacttaccgtgcgcgccgttgtaccagtccagcgaatccatattgctgaccagtgcggttatttgtttcggctcggtgatggtggtactaacattatgaaaaactgcctgtaccagctttttgtcatcttcgcctaaatgcacgagcatttttcggtagaactgcaactgctcctggccgatgcgggatttcaggtcatcccagcggtaaccttccggcaggtattccgcttcctgaccggtctctttacacattttcaaaaacagcagcgaggcgagttcattgacgtagttttgataggaaacgccgccatcgcgcaggttgtcgcacagcttccacagcttcgcgaccagatcgttattgttcattgtgagttccgtaaattaagcagcggcccaaattcatcgagccgcagaagaagaaattgccgagggtaatatacacaaaatcattcaggttgcatcaaggcggcaagtgagtgaatccccgggagcgtacagaagtacgtgaccggggtgaacgagcgcagccaacgcagaggcagcctgaaggatgaagtgtatacgtgtcaggccagctcgtcccagatataatcgctgaatttgcccagcagggtatcgagattatcgtcaaaggttctttgcagcatcgccttcccgccgcgacggtggaagttgccggttttgaagacatcgtcgtcgagcaccactttctctttcagcgcctgcgctaaacgatcgagccagcttaattgctcgctgctccagtcgttttcgcccttaatgcgcgtcagcgcgtgatcgacacgttcctcaaacggtttcagcgcatcgcccaccgcagcgcggcgaatatgaccaatcagccgggcggcgatatcttcattgcgcgtctctttccatgctttgcgcagggaagattcctcaaagtgctggcggtcaaaccactcctgtagctcgaccagccctttacgggtgagatcgcgcgggcgattaataactgcctgcaatgccggttgcgcgttcggggaacgttgcaccagcgagtcaaaggcttcgaggaaatcctgcggcgtgtcgtaatcaccgtacagcgattttacactcaccacttcatcgtcgatatcgaggaagatcggcgcatcattcaggttgttgatgtccgttttcagcttttccagacgggcgataaagccaggcagtttgttaaagacttcggcgctccagtgcggccctttttcccgcaggcgcgaggcgaagccgttaaagttcacgcccgccgcgtcctggcatagctcatccagacgacgcacctgtttatctatcgtttcgctgcggtcacggttaaacgtggccagaccgatgatacgctggagcttcgccaccagttgttcatggctgtgctcggcaaaactgcggccatccgcttcggtgattttataggtttctgaatcggtaatttcattgaccagcgtttgcagttccaccttcgggcgcaccaccaccggacgcatggtgtcgacgctctccagcgtgctgtagatatcgacacagtcaaaaatcttaaagctggttttattcacctccgggcataagcgcgtggcgcggcctttcatctgttcgtacagaatgcggctgcgtactttacgcaggaacacgatattacagatcgacggaatatcgacgccggtcgtcagcaggtcgacggttaccacgatattgggcagccgctctttattgaagcgggtgatcatggtctgcactttgcgcgcgtctttatcggcatcaccggtgatcttgatgatcgcgtcgtgctccagttgcggatactttttcttgaacgcggcacgcagctcttccaccaccatatcggcatgggcattggtgacgcagaagaccagcgttttttgcgatccggtcgggtcaagataattggtgagttcgttacagacggcgcggttaaacgccgggatcaccaggccacggttaaagtcggcgacttcaaaatcctgatcgtcttccagggtgtcattgatcacttctccctgcgggctgatgcgctctacctgctcgcctttggagagataaaccccctcctgcgcgttgcgggtgatgatctgaataggcggatcctggtcgatcagaaaaccgtcgataaccgcggtacggtaggtataacggtaaaccggctcgccgaaaatctgcacagtatgtagcgccggggtggcggtgagagcgatttttaccgcatcgaagtgatcgagaatgcgacggtaggcagagacgtaatccagctggctgcggaactgcagttcgccttcggtctgctctttatcgagaatatagccgcgatgcgcttcgtcaacgacgatacagtcgtaacgggccaccggcatcggttcatctgattgcagggtgcgtttcaccagcgactgtacggtggcaacgtgaattttggtgctgtcttccgggaatttatccgtcagccctttaatgtcgaaaatgctgttgaaggtgtcgccgttaatacgcgtatcttcaaacgcgcccagcgcctgttcgccaagagaacggcggtcgacaaggaagagaatgcgtttaaaacgctgggactggatcaggcggaacatcatggcgattgccgtacgggttttaccggtaccggtcgccatcgccagcaggatctcttgttgccccttgacgattgccttttcaaccgcgcggacggcatcttcctgataataacgcaggcccagctcgctcatgccagggttatcggcaaaccactgattctgtttttgcggttcgctgccgagcatttccagcagctcttccgggcggtgccactcgggtaaggctttcgacatattgcgggtatcacgcacgtcgcgataccagatgccgcttttggtcttcattgttgcgcggtattcgcgcccgttggtcgagtagcagaaggggattttaaaccgttgtttgccgctggtgtcctgccagctggtttcatactctggcactgcttcatgcacttcatccggtgagtagtgctcaagcaaggtttcccgcaggaagccattatcgaaacatttactgtagcgatacgactcattgagcctggcgggaacgtcgatattgttacgtttcgcctctaccaccgcgatgggtttgaggccgacaaacagcacataatccgcaaagccctgattacccgtttcatcttttccggtcggccattcggcaatggctttattgacgccgggttccggacgtgcgcctttggagaagcgcagggttttgctgtcggcctgccagcctgctttacgcagttgcgcatcaatcaggaagcgactctcttcttcgctaaggttgagtgtgcgcttgatggcctgatcggtaatttctttgtggtaagccttacgttcctgttcggtctgttttgccagttccgcgttcttctcggcgagctgtgcttccagtgccgcaaggcgagcctgggtttgcgcttcggtttcctgctgtttgccttccagaatggcgatatagccgttcagggcaaccagcttctgctgttgcgcttcgacttctgcctgagtctgcgctttttctcgcacctgctgttcaagctgttgttttagcgtcagcacttcctggtgatagaggttttcaccacgttccggcaacacaaacaccggcaccgggaagtcataatctttagtgaccagacggtagtaccagacagccaggcggaacccgagtcgcaggcacatctgggcatcgttgagatcgttatgatattcgtgcaccgcctggttaccaatgcggcgtaatttgtgaaatacagagaggatgttgtcatcaacaaaggcgattttgccgagttcacgcaggagatcgtgttgattctcacaaggggggatgttgagtaacagaccaagatgtttcgctgtggcttcgccaaacatacgcattttaatcagcgtcgtgttgggatcatccgggtagttattttccgccgcacaggcgatggcataagtgaagtcgttgacgcccttcaggaattcaaaattggatttattcatcattgttattaatccattgctgtgcgggcctgtccaaatatttaaggcccataacatctcatcttagctttctgtacctttccgggcaatgaccacggtcacagcaactgactcatttctaacgtgttcgtctatttttgtagtgctatagtagccgaaaaacatctacctgattctgcaaggatgtactatgacggttcctacctatgacaaatttattgaacctgttctgcgttatctggcaacaaaaccggaaggtgcagccgcgcgtgatgttcatgaggctgccgcggatgcattaggactggatgacagccagcgagcgaaagtcattaccagcggacaacttgtttataaaaatcgtgcaggctgggcgcatgaccgtttaaaacgtgccgggttgtcgcaaagtttgtcgcgtggcaaatggtgcctgactcctgcgggttttgactgggttgcgtctcatccccagccaatgacggagcaggagacgaaccatctggccttcgcttttgtgaatgtcaaacttaagtcacggccggatgccgtcgatttagatccgaaagccgactctcccgatcatgaagaacttgcaaagagcagcccggacgatcggttagatcaggcgctaaaagagcttcgtgatgcggtggctgatgaggttctggaaaacttattgcaggtttctccttcgcgctttgaagtcattgttctggatgttttgcatcgcctggggtatggcggccaccgtgatgatttgcagcgtgttggcggtactggagatggtggcatcgatggtgtgatatcgcttgataaacttggcctggagaaagtttatgttcaggcaaaacgttggcagaatactgtaggcaggccagaattacaggcattttacggcgcactggctgggcaaaaagcgaaacgtggggtgtttattaccacttctggatttacttctcaggcgcgtgactttgcccaatccgtcgagggtatggtgttggttgatggggaacgcctggtgcacttaatgatcgaaaacgaagtaggggtttcttcacgtttgttgaaggtgccgaaactggatatggactattttgagtgaaatatcaggccggatgcggctgcgccttatccggcccataaccccttacttcctcaaccccgcaaacgcagcccgaatctcttcctccggcagctggatcccgataaacaccatcgtgctatgcggtttttcatcgccccacggcctgtcccagtcggcgctgtagaggcgctggacgccctggaacagcaggcggttaggttcgccgtcaatccacagcatccctttgtaacgtagcagtttatccgccgactccagcagcaggttttccatcacgcgggaaacttcgctgatatctaccgggtaatccagttccaccacaatcgacgaaatatcgttttgtttatctgcgataaagtggaaacgcggtttggtgctgacgacgttttcttccagcataaaaccgttggtgttgaacagcaggcccagatcgatgtcgccgtgggtgacggtgtagaccggtgcgcgggcgttgatgcgcgccaggcgttcatgcagtttttctgcttcgcctgcgacgtcggttttggtcagcagaatgcggtcggcgtagccaacctgtgactgggcgatggtgaactggttcatctgctcatcggcatgtaccgcatccaccagcgcaatcacgccgtccagcagataacgctggcataaaacttcatgggagaaaaaggtctgaataatcgggccgggatcggccatgccggtgcattcaatgaccagacggtcgaactgaatattgcccttgtcgagattgtccagcaggtcgagtagcgcgtcctccagctcgttggagcgcgaacaacagatgcagccgttggtcagcgttttgatctgcgtggcgcggtcgccaatcagttgatcatcaacagagacttcgccgaattcgttttcaatcacggcaatcttgtagccgtgctgttcgttaagaatatggcgcagcagggtggtttttcctgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacatagttcactctgataagaacaaagccccgccgaagcggggctaaacacggttagtggtgcgaagagatcttcacgccgccttccgggattggaacgtacggtgtttctttgtcagtacgtttgtcgctgttacgcaccgcaagccaggttttgaaaccgtagaagatgatgctgtacaccacaatcaggaacagaatactcagacctgcgttggtgtagttgttcacaacgatgtggttcatattggcaatctgctgcgccgtcaggtcagtaccgttagcaatcttctctttgtactggcttgccatgtagaagaagccttccatctgcgggttggtgctgaacagtttcaggcccagcgcccaggtggtgcagataagcagccatacagccggaacaacagttacccagatgtattgggtgcgcttcatcttaatcagcacaacggtgcccagtaccagcgctacggctgccagcatctggttggagataccgaacagcggccacaggctcttaacgccgcccagcggatcaaccacgccctgatacagcaggtagccccacagacccacacagcccgcagtaccgatgataccggcaaccagagaatcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacgtgcgcgatacctaccgccagcgtcggcgcgccacctgcacggttcaggacagaaggctcaccaatgtctttcgcggtttgcaggatctgctctggcgaaatcacgaagccccaggagctgacggtcgctgccgcgtgtgcggtaacgtctttcagctgcgccatgatgatcggcgcgttctcgccacccatttcatgcaggttaggcatggtgatgccaaggccagcaggcggggtgttcatcgcgaagtaaagacccggttcgatgatggacgcagcaaccagcgccataatcgccacgaaggactccatcagcattgcgccgtagccgatgaaacgcgcgtcggtttcattagccagcagttttggcgtcgtaccggaagagatcagcgcgtggaagccagataccgcaccacaggcgatggtgatgaacaggaacgggaacagagcgcctttccacagcgggccagtaccgtcaatgtactgggtcatggcaggcattttcagttccgggttcagcaccacgatacccagcgccaggccgacgataacgccgattttcaggaaggttgccagatagtcgcgcggtgcgaggatcagccacactggcagcagtgcggaaacaaacgcatagccaatcagcgcgaaggtaatggtggtgtctttaaaggtcagtgccggaccccagtacggatcgtgagcaatcacgccaccgaagtagatagaggcaaccagcagcacgataccaatgacagagacttcacccacacgccccggacgaataaagcgcatgtagatacccataaacagcgcaatcggtacggttgagcaaacggtgaagacaccccacggactttcggccagggctttaaccacaatcagcgccaggacggcgaggatgatgatcatgattaagaaacagccaaacagcgcgatagtccccggtactggtcccatctcttctttgatcatctcaccaagagatgcgccattacggcgagaggagataaacagcaccataaagtcctgaaccgcaccggccagcacgacccccgccagcagccacagcgtgccaggcaggtagcccatctgcgcggcgagaaccggacccaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcatcaccttctgggcgatgtacagactgtagtagcgatacgccaccagatacaccgatacagaggcgaccacgatccacagggcgctgatgtgctccccccgacgtaatgcaactaccgcgaggcagaatgcaccgatgattccgagaatcacccagggtatgtgcttgaatatctttttagtatccatagtaaaacctggcatgtattgattaatagttggccgaagccgttctaggtttgcgttgcgtttgaggaggtaaattgaccgctatcctgtagtgatgttgccagagttacgcgcgcgtaaagtaaggtaaataactgagtggttattttagggatgtaagcggtcagttttgcggttgagcggcaaaggcgtcgtttaagtgacgataaatatgtgattcatatcacatatttatattgtgaataatttatgtaaataatggctttttaaattcagagtgtgaataaaattcactcggcgtaatctccgcgggatattcataaagtttttcctttccaggccgaaaatcttgcatcggtccacaggaaagagaaaccatgttaaaacgtatcaaaattgtgaccagcttactgctggttttggccgtttttggccttttacaactgacatcaggcggtctgttctttaatgccttaaagaatgacaaagaaaatttcactgttttacaaaccattcgccagcagcaatccacgctgaatggcagctgggtcgcgttgttgcagacgcgtaacaccctcaaccgcgcgggtatccgctacatgatggatcagaataatattggtagcggttcaaccgttgctgagctgatggagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatccaactgttaggtgcaggcaaaatcaacgagttctttgatcagccgacccagggatatcaggacggtttcgagaagcagtatgtggcttacatggagcaaaacgatcggctccatgatatcgccgtcagcgataacaatgcctcctacagccaggcgatgtggattctggtgggcgtgatgatcgtcgtactggcggtcatcttcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaagcagaacgccgaaaatgcgcgccaggccagccatctggcgttaagtgcttctgaaacggcgcaacgcggcggtaaagtggtagataacgtggtgcagactatgcgcgatatctccaccagttcgcagaaaatcgccgatattatcagcgtaattgacggcattgccttccagaccaatattctggctttgaacgcggcggttgaggctgcgcgtgcgggtgagcaagggcgcggttttgcggtggtcgcgggagaagtgcgtaatctggcccagcgcagcgcccaggcggctcgtgaaattaaaagcctgattgaagactcggtggggaaagtggatgttggctctacgctggtcgaaagcgccggggaaacaatggcggagattgtcagcgccgtgacccgcgtgacggacattatgggcgaaattgcttctgcttctgatgagcagagccgtggtatcgatcaggttggcttagcggttgctgagatggaccgggtaactcaacagaacgccgcgctggtggaagagtctgccgctgccgccgccgcgctggaagagcaggccagtcgcctgaccgaagcagtggcagtgttccggattcagcaacagcagcgtgaaacatcggctgtggtaaaaaccgtgacgccagctgcgccgcgtaaaatggccgtggcagatagcgaggagaactgggaaacattttaatcgccatgaaaatgcccgataagcaaaatgttatcgggcataaggagattaatctttacgtgggtcgttgatcggctgacgaaccaggaagatgtacgccagtgcccccgctgcggtgacgcaaccgcagatgattagtgccagacggaatgagtgggtggtatcaacaataaaaccagtaatgatcggcgcaaaagaggcgcagatgaagctggcaaagttctggatactgcccaccgacgcagtcatgcgagaagcaactgcgacgtggatcaagccccagcaggatgttccggcaaagtgaatacagaacagtgccatgccaatcagcagaaccgccgtcatggatgttgtcgcttgtggtactatcagcgtaaaggcggcagaacagaacatcccggcaataatgcagatcttacggcttttaatcggagccattccccctttgaccagccagtcggtaacgtaaccgttgaccagcatcccggcagccccaaacaggaaagggatagccgccatcaaccctgtgctttttaaatccaggttataggctgtttgcaggtaaccaggaagccaggccagatacagccacgcagtgtagttgatgccactgaatccgagcatcattccccacattgtacggttacggaacaggctgcgccattcggcaaaactgagcggatctcggcgggcattgacgctacctgcattgagataagcttgctcaacggcagtcagttctacgtgctcgcggttgcgatagagcatataccagccgatggcgagaaaaatccccagtacaccaatggtaataaacatcccgcgccagcccatcaccagcatcatcgccgccagaatcggtgggcttacggcaacgccaatggtagaagctgcgttgaagaagcccatcgggcgtccgcgctctttgatgttgaaccagtcgttaatgacttttacaccgcatgggttcatcggcgcttcaccaatccccataccgatacgcaccaacacgaactgcgtaaagttgtgcaccatgccagacattgcctggaacagtgaccagaagaacatccccagtcccagcatcaggcgtgggcctttacgatccaatagtgggccgcaaggaagttgcgcaatcccgtaagcgagtgaaaacacggagagcaaagcgccgatttcggtggcacttaatcccaattcttcacgaatcgttaaatttgctaccgacagcgaactgcggtcgagataattgattaccgccgcaaaaaataataacaacatggcggtggtttgaatgcgtttaattcgggtactgcgttgaactaatccatctggtggcacgggaatatctgccgacgaagatggagtaaatgaagaacgcggatcgatggtgatattttctttttccacgccggactcctgtatttataattttaattgtttacgtaattgtgcattacgcaaggttgacattaacggcaggttaaagttttaggactttactaccgctcacaaaaacatttttagtcgactgattgtgagcataggtaagcgggaatttcccggtatttatcttttgataaaaccgtgcacccgctaatagtttgctgtttttaatccgtacttaatgagcataacgcgtgttctcattaatggatcgaatcattgattgtttagctgaattcaaatggttacggagcgcaagggtggcatcaaggtcactgcggcaaatcagagcgctgagaatggtcatatgctcatcgacggcaatgatattgcgctgtttaagatcgctttcgtcccattgatagtgaaaatgaaagatgactgagatgatctcaagcgattgatcaaaaaagatattgtcggcagctgaaagcagtaaggagtgaaaatctctgtcaagttgcgagaacatgcgaaagctattgccgatgttgtcacgcagtagccgatgacgttcgagcatggttttcgcctgcagccagcggggatcatgatcaggcaggttgagaaagtgctgaagtgaatgtgtttcgagcatttcgcgtagctcaaacagctgctcggcgtaggattgatcgaattgcttcatgctccactggccgcgcttttcgctgtgaataagattataacggccgaattttaaaagatattctcttactacaaccgggctgacacccgcggcccgagccagttgcagttcagaaaacgtttcccctgggcgtaactggcgctggtttatcatcgtgaaaaaagcctgctcaaacactttgttttgttcactcattgaagcggtagtacaggcgaaaccgtcatcatggtcaggtttacgcgcaataacatagtcgtttccaacctgcgtcaagacgccgcattcgcgtaagtggctgagaatatgacgcactgtggtgcggctgatgttgtacatttccgccagcgcactttgcgatggaagtggggaagggatatgaccccgcgccatatcatcaatgacctggttaatcacattgtggcgtaaattttgtgaacgactcatattttcctccttgtgagtccattaaaacccgatttaaaacatttttatgcgtgtgttttcacaaaaaagattttccgttccgctgccatttttcattttcattgatatctaaggcaacaaaaagtggagagccgaatcatgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgctgacatgatgttaacccatcgctatccgttcgccacgctggcagaaacctacgagcgcgatgtgattaacaatcgtgagttaattaaaggcgtaattactttctgataaggcgagattattaaagttgccatgcagcgtccggggaagtgttgggcgctgttttttttgtttcttaataatgtgttgtaagccgtagaaggcgtgtaggtcgcaccctatgcgacctacacatcagtcaggaattacccttcacgttctaccactttaatttccaccatgccgatcccgagcttacgcggcgagtgtccgaggatattcccttcgttggttgagacaggttccggcggcacaattaccagtgtgtcggcatcggttgggttatcgaaatgcagtgtggtggtggtcacttcattgcccagcacaagagtttgttcttcattgcctacgcgtaccggaataggacggctggcgttattgccgtatgctttggcggtaatcaccaggtcaaatttcttcggcagcggatgcttgtactcgatttttacttcatcgcccagctgcgcgttggaccagcggccccacgactccggacgggaaatcccgctaaactgtttcacctcttctggcgcaccggcgacgttaaagatgaaactgtcggctttgtagcgaatatcgttatcaacaatcttcagcgtatcgacattgcctttgtaacgcgccatgtcgatgaccgtatctttaaatgccgttttgccctgccatgttgttttgtcaacatgctgaacaatttgctgaccgccaagctgcccttgcgagacacaccagtcggtggaaagtgccagttccggagcccagagttgtgccatcttgtagcaacggtcaacccagacgaaattgtcgcgtggagcgaaatcggccagctggaaacgcagcggtgctgagtattcgctttccggcagcggttccacgcgtttgtctgaaacccgcaacagcagcggcaaacggaaatggctacccgagaaggcaatcatgtttttctgctggtcgatggtgaactctttcatctctttagggaatttccacaggcggatgatatctggcttccacgccaatgttttctctttgatattgaggaagatttccgacatcgactgcccggataaactgctacgaccaagtccgagatagttatcgccaccgagaatgtccagcaccgtcgcgccgttatccatcgtgttacgcttcactgccagcgtctcttgctgcggcttgtcgccacgaatgacaaaaaacaggttattgcgatcctgcttattgaggtatttccacgccgtgttgttcatcgctaaatggtcagaagagacgacgatgacggtatctttaaaccacggtgacgctttgattttgttgataaacgtcgcgatgttctcctggctgcaacttaccgcgctgaatgactgattcggtttaccgtcaaaatcatattttttgcggttacaggtacgagagataaaaccatccgggtgatgggtatcgactgtcagggtaaacagtgagaatcgctgacctgagcgggaaagctcttcaaactttttccacgcttcatcgagaacggtatcgtcgtagaatccccagtcgttgcgatagtgcgggtcggctaccacgcttttcagctcttctgagccgtataagtggtcgaagccatgcgacttcaggaacacatctttaccggcaaaacgcagattcgcgccctgcacgaaatagttctgataacccgagtttttcaggatatctcccagacagatgttctgcgggaagaagctggagacagaggcggaggcgttgccttcaaagggggcaaacagcggtatgccgcactgagaagccaccatgcccgcaatcgtgtaatctgttcccggcagctgctgcgtgtggctgaaatccaggccttcatttttcaacgcgcccagttcaggcgtgagatccgggaaagcctcgttatcaaaataggtccgctcgagactttcgccgtagatataaaccaggttgagtttcgggtcagggatagttttcgacggctctttataataagccgcaaagtccgggtcgccgtcgcgtgactgggatttcaccagttccgttatctgacgaaatgccgggctggcgtccaccgaacccagcgccagtaagagcgccagcaggctgtaaccaaaatggtgcggatgatggcgacgacggcgcaggatccagcccagcgcaccgaacaccgctgtcagccccagcacaatgccgatacccggcaaaatgtatttgctgacgccagcaccggtcaggctgttggttaaggtatagagaaccgcgtcgttaataccatcgccagtaaaatagtcgctggcaaacagggtgatatttaaaacgacaaatagccccagcaccgttaacgtggctgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgattacggtcacttcccgtgtaacaggggtaaaaccgtccaggagcagggaaaagggcaggagagagccgcgtcagccgggtaacagctaaaacgcggcgtttcgcggttcaggaaatgaagttcagcccctgttttaacaccagatcgcaggctttggttttcaccttttctgccagcggagttgttccgatgttatccagattgagttgctgaccatctttggttttcagcaaaccctgaatgccgtccagatagttggtgtcttctttttgctcttcactgttcaggcccagcttttccagcacctggttcttgatgttttcggcatcggttaccgacgccagcttttgcttcgcgcagtattgcagaatgcctgcggcattgttcatgttatctgcgcttaaggcctggtttccgctgctaagcaagttagttaatgacgcgagcgaccaaccgccttcctgtgtcgtgctgttttggttgccaagttcgctggcggcgctggagagcgcatctttccaggacgcagcatgcaccccggtggaaattaatgcgctggcggcaatggcacagcacagaagatgtttaacagttttcatcatcattactcaaggtggaattgtgtcgcagtataccgccagaaacggggattaatactctttacctgttacccggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttgatgatcactttttcgtatttcgattcggtctgcacgccgatctcatcgatcaccagcagatcaacgttgctcagatcgttaagcagttgttcttcgctggtaccgctattcctgaaggtatctttcatcgccgacataatatcggccacggtgatgatcaatacggatttaccgcgtagcagcagctcgttgcagattgccgccgccagatggtttttgccggttcctggcttaccagaaaagatgaagctggcgatgttgccgtcaaactcttcgacatactggcgcgctttgcttaacgcattcatctgcccttcacactcaacgcgatagttctcaaaggaacagttctgatgcagtggacgaataccggagcggttaaaggtgcgctgcattttcatcgcccgattttcacgttcgagagcggcggagcggatcgctccttgttctttttgccaggccagtagttcttcacccgttttgaatgcgggtttgatatgggcaggcatcattttttgcaggcgttgcatcaggtcgccaacgtttttcatcgttaccctctgaatcctggtggaatttggctgtcaggttcgctgaccgtattcacatctcgtttcggcagtccgccgttgctggcacgaccgatttgcaggctgcgcgccagtttttgttgccactgcacatggtgaaagactttaccttccgcctgccagtaggcaatgaatgaggccagttcttcggtggtcaccggctctcttagcgccacgccccatagcgccgccaggcggataaaatcggcatcgggttgccagtccggatacatggcgaatttccccatgggtacagcaacgggagcggcttgcggttcctgatagagttgatcgtccagagcgacatcgcttcccggacgcgccagcttttcttccagcgccagcagttcagccaggcgtgcaggcgtgacggcataaaacgccggggcattgttagcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggaggctgtctctcatccgtgtgcttaagcgaggcaattttatacgcgagggcgcttgcggtacaaccataatccaggaatggaaagaccgatggataacgcaccaacaatcgatgaagctgtaagaaagttggttaacagggtaatcatcaacggttcgctgtaacctaactggctgatttttaccgccgaaatcattgcggtataagccgatatgcccgggaacatagggataacggccgccacggtaaacactttcggatgcgccagataccagcgcgaccattgaataccaatggtaccgaccagcatagaagccataaaggttgaccactcaatattcaacccgctggtcatcaagatcattcgggaaccatgacctatcgagccaagcagcgcacaccagcgtaacgcccgcacgggaacgttgaacaccatcgcaaagccgaccgcaggaatggcggcgaggatcatatcctgcgccaacgctaacagaaattcgatcacacccatccgcgtagcccccaaatcgtcagtgccatcactacgccgacgcaggtagccagtgtcagcagactggcgatcgcccagcgtgccagtccggtattgatgtggcctttaaacatatcggcgacggcattaatcaacggaaagcccggcactagcagcagaacgctggcggccatcgcaatggtgggggtattgctgaaagtggggagttgcaaaagcaatccggaaatggtggtggcggcgaaagcggtaaggcaaaagttgatctgtggatgaagatgacgttgtgccagcagctggcggatatacatcgcggtcgtactggcaaagaaggtgatgacggcaccatcccagccaccgttattgagtttacagaaacaggcgcaagaaaggccaaccattaaggctaccagccatcttgggtaacgtaatggctgaatttggctaaatcgtttctctacgcctttgtaatccagcagatgatgctccgcaagaatcacaatgtgctggacttcagtcaccacatgcatattaatgccgcgatcgtgatttttacgtgtcgatgtcaggcattgcccatctttaatagttgtcagcactatggcgttcgaagagatagaactttcgacgctgtccattcccagtgcccgacccagtcgtgaggaaagctcatcaaccaacgcgctttccgcaccatgttgcaaaagaaataatccacactggatacaaagccgtgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagaagctcggtgataaaaagcgaattatctctcgccgcaaacaaactatcacatgaatattatcatcataatgaatttattgtttggcctttacgaatcaggataatagataaccgggcacgttttttaatgttaacaagctaaaaccatcagatttcattgaataaatattggttgtgtgattttgcattctgcgggaagggatatcatttaattataaattaaatgaatgtgatttctgtttttcattaagtattcctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaacatttaaggaatgaatatcctgaataaaccatcataatttttagacagtggatgtggaggaaatatgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttagccggtgaaagtgaagatccacgttctgtttgtgaacattattattctttaatctcacaatatcgggaaattcactgggttttcatggtgtcacgctcctggtattcccaggcagtagaactgctcatgtgccctacggcgacgttattgtctgatgttgaacccattgagaatctggtcaagaccgtacgttccggcaatacgcacgcagagcgtatcagcgccatgctgacctccccggcaatgactgaaactcatgattttagctatcgctccgtcattctcactctttcagagcgcaaggtactgcggctattaggtaaaggatggggcatcaaccagatagcttcattgcttaagaaaagtaataaaactatcagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatagaaaaatgcgtcatgagtagtatcggtattgagagtttattcagaaagtttgcgggtaacccttataagctccatacctataccagtcaggagtcatttcaggatgccatgtcgcggatctcgtttgcggcggtcattttttctttttctgccatgagaagtgagcgcagagagggattatcttgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgaccgactgaacaatcagtggtacattaaccaaagccggacgttaagcccgacggagagagaaatattgcgctttatgtcgcgtggctactcaatgacacaaattgccgagcagcttaaacgcaatatcaaaacgatccgtgcacataaatttaatgtgatgtcgaaactgggcgtcagttctgacgcagggttgttggaggccgcagatattctgttatgtatgcggcattgcgaaacaagtaatgtgttgcatccctattaatccgcatgatgccgggtttacttccccggcagtgctttcatttcagcgtacaatcgccacattgctgcacatccggtaagcgataacgctggcagcaagtgcggcgcaccagcaggccgtcgcgcagtaccacggtacgccagagtggattatcttcaccgttcgtgagcgttttctcaaaaaagagggcatggcgcagcgattcaacagtagcctcgccgagcagttgcttcatctcagtgagataccagttgatcaaataaccggtattactccagataagtttgccgttgatctctccggtcgcttctagtgcttgcacaaccggaaccagcgcctggctgattaacgtttccattcgatgctgcggcgaatgtggtgttgcgtttttatcttcacacacatcgacccagaaacaggcgacgcgtccggtttcgtgaaactcagcatggaaatgttccggcgacacatctaatgccttttcctgcgtcagtagcgccagcattaatggtggcaccatcaggccgatataccattgtgcccatagtgagatcagcggtttgttctcgcggatcatcatcggttggttgcgatagatatgatcggaatagaccgccagcagagaacttagcacattcggtgatgaccattgcgccagcgtcatggcgttaagtggggcaggttcatccaggcggataaactccagcaaatgttcacgatgttttgcgatcgtcgcccgcacggcttgcgcaagcgtgggatcctgcggctggagatgcgttcgccagatgacatcttcatagagcggtgcggaacgataggccataatcgggatagtaatctaaatgataatgattgctaatcatagcgataggtttacccgatagcaagggatttatctggcttgcaaatgataaaaattatcatatgatattggttatcattatcaatgaaagagatgaaatcatgttgcaacgtacgctgggcagtggctggggagtgttgctgccgggattgctgattgcagggctgatgtatgcggatttatcgtcagatcagtggcggattgtcattctgatgggattagtattgacgccgatgatgctgtatcacaaacagttgcggcattacattttgctaccatcgtgcctggcacttattgctggcatcatgctgatgataatgaatttgaatcagggatgaaaaatcaaggaagaaacaagaaaggaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgacagaggtgtaattgctggaaaaatgtccatcaggaaactagcgtgcaggtttggtatgcatgcgggggcagatgccagatgcgacgctggcgcgtcttatctggcctacgaagggctaacgtgcaggttttgtaggtcggataaggcgttcacgccgcatccgacacggtattcggcgagataattaacctttcttcgcctggcgggtcataatggcgcgatacaccttgaagcgccctgtttgcgcgatcacttcgtggaagccaaatgtctcatccagcacgtccggataaggcaggaaggcgttcgctacaattcgcagctcgccgccgctattaagatgacgcaccgcaccgcgaatcagcgtttgcgccgcatccaggctggtttgcatcccatcgtggaacggcgggttggagatgatcatatcaaaacgacctttcacctcggaaaagacgttgctggcaaagacttcaccttcaacaccgttggccgcaagtgttgcgcggctggcttctaccgccggggcagagacatcgcacaaggtgagacgaattttcggcgaatggcgcgcaaaggcaactgaaagcacgcccgcgccacagccgacatccagcactttacctttcgtgtgcggagttaacgtcgagagcagcaactggctaccgacatccagaccgtcgcggctaaacacgccaggcagcgttttgaccgtcaggccatcgacgctgtattcgccccagaatttctccgcatcaaataccggctgtttttccagacgaccaaaatagaggccacagcgacgagcgctgtcgactttattcaacggcgcataatctgccagcatctgctcggcgctgcgcacgccgctgcggttctcgccaacgacaaaaatatctgtccccactggcagcagagaaagtaaattcatcaactggaactgggcttccggtttgttcttcggccagtagtaaatcagcgtatcgcaatctgcgacgtcatccgccgtggcgaccagactgaaacgggcgttatcccccatctggcggcttaatacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccggcacacgtccgtctggtgatggtggcaaacgatcttcccgccctgactgatcctttagtgagcgatgttctgcgcgcattaaccgtcagccccgaccaggtgctgcaactgacgccagaaaaaatcgcgatgctgccgcaaggcagtcactgcaacagttggcggttgggtactgacgaaccgctatcactggaaggcgctcaggtggcatcaccggcgctcaccgatttacgggcaaacccaacggcacgcgccgcgttatggcaacaaatttgcacatatgaacacgatttcttccctcgaaacgactgatttaccggcggcttaccacattgaacaacgcgcccacgcctttccgtggagtgaaaaaacgtttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacactatggctggaagtccgtgcttcaaacgctgccgccattgccctgtacgaaagtttaggctttaacgaggcgacgattcgccgcaattactaccccaccacggacggtcgcgaagacgccatcatcatggcgttgccaatcagtatgtaatacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgagccaggtaaactcaacgaagcctttattaatgcgatggcggaaatctgcacgccgctgccgggcgcggtttctctgcttaacgccattcgtggcaacgccaaaatcggcatcatcaccaacggctttagtgccttgcaacaggtgcgtctggaacgcacgggcctgcgtgattacttcgatttgctggtgatttccgaagaagttggcgttgccaaaccgaataagaaaattttcgattatgcgctggaacaggcgggcaatcctgaccgttcacgcgtgctgatggttggcgacactgccgagtccgatattctcggtggcatcaacgccgggcttgcgacctgctggctgaatgcacaccatcgcgagcaaccagaaggcatcgcgcccacctggaccgtttcttcgttgcacgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcacccggacgccggtaagactaccatcaccgagaaggtgctgctgttcggacaggccattcagaccgccggtacagtaaaaggccgtggttccaaccagcacgctaagtcggactggatggagatggaaaagcagcgtgggatctccattactacgtctgtgatgcagtttccgtatcacgattgcctggttaacctgctcgacaccccggggcacgaagacttctcggaagatacctatcgtaccctgacggcggtggactgctgcctgatggttatcgacgccgcaaaaggtgttgaagatcgtacccgtaagctgatggaagttacccgtctgcgcgacacgccgatcctcacctttatgaacaaacttgaccgtgatatccgcgacccgatggagctgctcgatgaagttgagaacgagctgaaaatcggctgtgcgccgatcacctggccgattggctgcggcaagctgtttaaaggcgtttaccacctttataaagacgaaacctatctctatcagagcggtaaaggccacaccattcaggaagtccgcattgttaaagggctgaataacccggatctcgatgctgcggttggtgaagatctggcacagcagctgcgtgacgaactggaactggtgaaaggcgcgtctaacgagttcgacaaagagctgttccttgcgggcgaaatcactccggtattcttcggtactgcgctgggtaacttcggcgtcgatcatatgttggatggcctggtggagtgggcacctgcgccgatgccgcgtcagactgatacccgtaccgtagaagcgagcgaagataaatttaccggcttcgtatttaaaattcaggccaacatggacccgaaacaccgcgaccgcgtggcgtttatgcgtgtggtgtccggtaaatatgaaaaaggcatgaaactgcgccaggtgcgcactgcgaaagatgtggtgatctccgacgcgctgacctttatggcgggtgaccgttcgcacgttgaagaagcgtatccgggcgatatcctcggcctgcacaaccacggcaccattcagatcggcgacacctttacccagggtgagatgatgaagttcaccggtattccgaacttcgcaccagaactgttccgtcgtatccgcctgaaagatccgctgaagcaaaaacagctgctcaaagggctggtacagctttccgaagagggcgcggtgcaggtgttccgtccaatctccaacaacgatctgatcgttggtgcagttggtgtgctgcagtttgatgtggtggtagcgcgcctgaagagcgaatacaacgttgaagcagtgtatgagtcagtcaacgttgccactgcccgctgggtagaatgtgcagacgcgaagaaattcgaagagttcaagcgtaagaacgaaagccaactggcgcttgatggcggcgataacctcgcttacatcgctaccagcatggtcaacctgcgcctggcacaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttcgctgatatcccgagcggtttcaaaattgtgatctatatttaacaaagtgatgacatttctgacggcgttaaataccgttcaatgcgtagatatcagtatctaaagccgtcgattgtcattctaccgatattaataactgattcagaggctgtaatggtcgttattcatcactcatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcggaaaacaacgcgcagactaccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtaaaaaccgatcaaaaagtcgtgaccctgagcggtttcgttgaaagccaggcccaggccgaagaggcagtgaaagtggcgaaaggcgttgaaggggtgacctctgtcagcgacaaactgcacgttcgcgacgctaaagaaggctcggtgaagggctacgcgggtgacaccgccaccaccagtgaaatcaaagccaaactgctggcggacgatatcgtcccttcccgtcatgtgaaagttgaaaccaccgacggcgtggttcagctctccggtaccgtcgattctcaggcacaaagtgaccgtgctgaaagtatcgccaaagcggtagatggtgtgaaaagcgttaaaaatgatctgaaaactaagtaattcgtcgtaattcgtcctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtaccgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacgaatagctctggtgtgcgaaggcggcggacagcgtggaattttcacggctggcgtgctggatgagtttatgcgcgcgcagtttaatcctttcgatctttatctcggcacatctgccggggcgcagaacctctcggcgtttatctgcaatcagcccggttacgcgcgcaaagtcatcatgcgctataccacaaaacgcgaatttttcgatccattgcgctttgtccgtggaggaaatcttatcgatctcgactggctggtggaggccactgcaagccagatgccgttgcaaatggataccgccgcgcggttgtttgacagcggcaaatcgttttatatgtgcgcctgtcgtcaggatgactacgcgccgaattactttttaccaaccaaacaaaactggctggatgtgattcgcgcctccagtgcgatacctggcttttatcgtagcggagtgtcgctggaaggcattaactacctggatggcgggatcagtgatgcgattccggttaaagaggcggcaaggcagggcgctaaaacgttggtcgtcattcgcactgtgccgtcacaaatgtactacacgccgcagtggttcaaacgcatggaacgctggctgggtgacagtagcctgcagccgctggtcaatctggtgcagcatcatgaaaccagctatcgtgacattcagcaatttattgagaaaccaccgggcaagctgcggatattcgaaatttatccgccgaagccattacatagtatcgcgcttggcagtcggattccggcgctgcgtgaagactataaacttgggcgtttatgcggtcgttatttcctcgccacggttggcaagctattaactgaaaaagcgccgcttacccgccatctggtgccagtggtgacgccggaatcgattgtcattccgcctgcgccagtcgccaacgatacgctggttgccgaagtgagcgacgctccgcaggcgaacgacccgacatttaacaatgaggatctggcttgatttgccgttttatcgacacccactgccattttgatttcccgccgtttagtggcgatgaagaggccagcctgcaacgcgcggcacaagcgggcgtaggcaagatcattgttccggcaacagaggcggaaaattttgcccgtgtgttggcattagcggaaaattatcaaccgctgtatgccgcattgggcttgcatcctggtatgttggaaaaacatagcgatgtgtctcttgagcagctacagcaggcgctggaaaggcgtccggcgaaggtggtggcggtgggggagatcggtctggatctctttggcgacgatccgcaatttgagaggcagcagtggttactcgacgaacaactgaaactggcgaaacgctacgatctgccggtgatcctgcattcacggcgcacgcacgacaaactggcgatgcatcttaaacgccacgatttaccgcgcactggcgtggttcacggtttttccggcagcctgcaacaggccgaacggtttgtacagctgggctacaaaattggcgtaggcggtactatcacctatccacgcgccagtaaaacccgcgatgtcatcgcaaaattaccgctggcatcgttattgctggaaaccgacgcgccggatatgccgctcaacggttttcaggggcagcctaaccgcccggagcaggctgcccgtgtgttcgccgtgctttgcgagttgcgccgggaaccggcggatgagattgcgcaagcgttgcttaataacacgtatacgttgtttaacgtgccgtaggccggataaggcgttcacgccgcatccggcagttggcgcacaatgcctgatgcgacgcttaacgcgtcttatcatgcctacaggtttgtgccgaaccgtaggccggataaggcgttcacgccgcatccggcagttggcgcacaatgcctgatgcgacgcttgtcgcgtcttatcatgcctacaagtctgtgccgaaccgtaggccggataaggcgttcacgccgcatccggcagtcggcgcataatgcctgatgcgacgcttgtcgcgtcttatcatgcctacaggtttgtgccgaaccgtaggccggataaggcgttcgcgccgcatccggcagttggcgcacaatgcctgatgcgacgcttgacgcgtcttatcaggcctacaagtctgtgccgaaccgtaggccgtatccggcatgtcacaaatagagcgccggaaatatcaaccggctcaccccgcgcacctttaacgcatcagccaacggctcaacgtcttccggcgtggcgctcgcccagctttgcgcctcgccatacacgccgtgggcatgaaacgcgttcaggcgtaccggaacatcgccgagtcccttgataaacgccgccagttcttcgatgtgttgcaaataatccacctggccagggatcaccagcaaacgcagttccgccagcttgccgcgctctgccagcaaatagatgctgcgcttaatctgctgattatcgcgtccggtgagttgttgatgacattcgctcccccacgctttgagatcgagcattgcgccgtcgcacaccgggagcaatttttcccagccggtttcgctcaacatgccgttactgtccaccagacaggtgagatggcgcagttgcggatcgtttttgatagcagtaaacagcgccaccacaaacggcagctgggtcgtggcttcaccgccactcaccgttatcccttcgataaacagcactgctttgcggacatggctaagcacttcgtccacgctcatggattgcgccatgggcgtggcatgttgcggacacctcttcaggcaggtatcacactgctcgcaaaccacagcgttccacaccactttgccgtcaacaatctgcaacgcctgatgcggacactgtggcacgcactccccacagtcattgcaacgtcccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttcgcccagccaggtggtgttggtgcgtgaaccttcggcgcgatatttttctaaatccgacaaacgcaccatataaccggtaacgcgaaccagatcgttaccgctgacattggcggtaaattcacgcattccggctttaaaggcaccgaggcaaagctgtaccagtgcctgcgggttacgtttgatggtttcgtcgagcgtcagaatgtcgctgatgccggaataataataagcatgatgcggggcgacagtttgcagatgggtgatcggatctggctcatcgccatacggcaaacgcgcgcccggcgtggtgccgatatcggaactgatccccgactgtgcgtgtaacatggcgcgtttttgccagccatatttcacgggggtattggcgacaaactccgccagttgcgcgctgatgcgataacctacttcatttgcggcggcttctttaccgtagcgcgcggcaatcccttctttttcacacagcaagttaaccgcttccgccagcccatacatgccaaacattggcacaaaacgttcagggttaatcagcccttctttcaccaggaagctattctcaaagaagtgtgattgttgatagaggaattcacaccgcgcatcgatgatggcgatctgctgctggcagtagtgcggtagagtgcgcgtaaagaagtcatccagcgattcgctgcgctcggcaatggctttcaggttaaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgttcttcgccacttccagcagcaggtcatcaggggtgatttcaggatcgtagataaaggtcaggttcggtgaaacctgcttcaactctgcatctgcacgtaagatcgcgcgggtaatgggcgaatcagacgggccgatattggcgtgcataaaggcgtctggcagggttctgtcgaggtaacgccagaaacgttttattcgaacatcgatctcgtcttgtgttagaattctaacatacggttgcaacaacgcatccagttgccccaggtagaccggcatcgatgtgaccgacggtacgtggtggtaaagaatggtcagcagagagagtgcgtcatcaagatctttcgcgccttccagctccagccattcggaaccgttcgccagaaaacgggcgtaatcgggtaagacatagcgcggtttgtacggcgcatgaccttcaaacatatcgcagattacaccttcatccagcgcgcggcgggcttcggcaggaagctgtgggtaaggcagattgttttctgcttccagtgccagaaaatggcgcttctgctccgggctaagcactgggctggtgacaatttgctggcaacgttgttgcagtgcattttcatgagaagtgggcatcttcttttccttttatgccgaaggtgatgcgccattgtaagaagtttcgtgatgttcactttgatcctgatgcgtttgccaccactgacgcattcatttgaaagtgaattatttgaaccagatcgcattacagtgatgcaaacttgtaagtagatttccttaattgtgatgtgtatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatctgtatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaagtaagatgctttacgcctgatgcgctgcgcttatcaggcctacgagacgtatctacccgtaggccggataaggcgtagacgcatccggcaaaagccgcctcatactcttttcctcgggaggttaccttgtttctcgcacaagaaattattcgtaaaaaacgtgatggtcatgcgctgagcgatgaagaaattcgtttctttatcaacggtattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactccaccggtggcgtcggcgatgtgacttcgctgatgttggggccgatggtcgcagcctgcggcggctatattccgatgatctctggtcgcggcctcggtcatactggcggtacgctcgacaaactggaatccatccctggcttcgacattttcccggatgacaaccgtttccgcgaaattattaaagacgtcggcgtggcgattatcggtcagaccagttcactggctccggctgataaacgtttctacgcgacccgtgatattaccgcaaccgtggactccatcccgctgatcaccgcctctattctggcgaagaaacttgcggaaggtctggacgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgacatgaatcaggtactggcctccagtgcaggtaacgcggttgaagttcgtgaagcggtgcagttcctgacgggtgaatatcgtaacccgcgtctgtttgatgtcacgatggcgctgtgcgtggagatgctgatctccggcaaactggcgaaagatgacgccgaagcgcgcgcgaaattgcaggcggtgctggacaacggtaaagcggcagaagtctttggtcgtatggtagcggcacaaaaaggcccgaccgacttcgttgagaactacgcgaagtatctgccgacagcgatgctgacgaaagcagtctatgctgataccgaaggttttgtcagtgaaatggatacccgcgcgctggggatggcagtggttgcaatgggcggcggacgccgtcaggcatctgacaccatcgattacagcgtcggctttactgatatggcgcgtctgggcgaccaggtagacggtcagcgtccgctggcggttatccacgcgaaagacgaaaacaactggcaggaagcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaattgccggtgtcccggttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtttctgtcggtaaaattgcggacatctacgccaactgcggtatcaccaaaaaagtgaaagcgactggcctggacgcgctgtttgacgccaccatcaaagagatgaaagaagcgggtgataacaccatcgtcttcaccaacttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacttctgatatggaatatggcaaagccatgttctgatggatttgggcggagcgttgactccgcctttgttatgtcacaaaaaggataaaacaatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcagtagatgcagctaaagcactgggtattgatgctcgcgtgggtaacctgttctccgctgacctgttctactctccggacggcgaaatgttcgacgtgatggaaaaatacggcattctcggcgtggaaatggaagcggctggtatctacggcgtcgctgcagaatttggcgcgaaagccctgaccatctgcaccgtatctgaccacatccgcactcacgagcagaccactgccgctgagcgtcagactaccttcaacgacatgatcaaaatcgcactggaatccgttctgctgggcgataaagagtaattgtgtttcgctgcaaggcgattgccttgtgaagccggagcgggagactgctccggctttttagtatctattcatttttctctccagcttgaatattttcgctatacttttcagtgaaatgtgttaataaatctattcaagtatctattcacgaatctattcattaatgagcgagctgactgatcttttactgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtctggcgggtggacgataccggaaaggcgcataaattcgccgacatccggttgtgctggccgcagggaagttgtctggtaacaggcgcagatggcgacgaacagtggtttgatggtttgccctggtatttgaccgatctccgaccgcagggctttttagggcgcgcgtggggcaggaagttagccgcgcaactgaatctgactgatgatatacgtctctggcaggaagaagatgtgctctacgccctgaccgtatttaacggtgaatatactggcggttggttggtcggggaggggaattatcagcgatggattactgcacaacaccctgcggaaattcctctggatcaaaaactcacccattacgaacagctggcaagtgatgcactggcaggagaaattgtgggttcttctgcgggcggcgagcagccaaaatttacctactatgcacaaacgccgtcaggcaataaacatgtgttggtgaaattcaccgtaccacagcaaaccgcggtcagccaacgttggggtgacctgctaattgctgaatctattgccgcgcaaatcctgcgtgacggtgggatccacgccatcgagtcaacggtgcttgtaacaagtaacaggcaggtattcctcgaagcggaacgctttgactgcaaaggtaacgatggtcgcttgcctattgtgtcgctggaggcggtgcagagtgagtttatctcttctccgggatcgtggccgcaggcaatgcgccgtttgtgtgagcaacaacttgtcactcaccagagcgtggcgcaaacagaagtgatctgggcatttgggcgacttatcgccaacagcgatatgcacgcaggtaatttatcgttttatttatctgaaccgccatttgcgctgacgcccgtctacgacatgctgccgatggtctatgcaccaaacagcgctggaatgctgcgtgatgctgccattgaggtgaagtttgatcttaacgtcagtaaaagcgcttggttaacggcgatcccgctggcgcagcagttctggcaaacggtcgccagagatccgcgtatcagcgaggcgtttcgccacattgcgcaagaaatgccggaaaaaatccggcaaatcgaagagaaagttgcccgcatgggcgggtaactaccttacagcccccgccatccatgccgataactcccgtagctctttttcctgttccgggaagtcaaccaacagcgcttcgcactcctgttgcagcatatctgcgcggtacaggcagccttgcagtcgtccggcgagggcttccagcggcgcggggttgaggctgtcggtaaacacctgggcgcgggtgatatggcctttttcaacgtcgaaatgcagttccacgccgccccaggtaaagcgttcatccagcagatgcgagaatgccggagcctgaccgaagttccattcccagctactctggcgggcaaaggtttcggcgaagtttggcaagtctggcgttttgttcggggagatgatttccgcttccacgcgctcgccataatgggcgaaaaaggcctcggttatggcctcgcaaacctgctcatgggtgatccccggcaacagctcggtgaggttggtcacgcgggaacgtaccgacgtaatgcctttcgccgccagtttctttttatccggattgagatagtttgccaggcggctgaggtcggcattgagtagcaaggtgccgtggtggaagccgcgatctttggtttcgcgataggccgagcctgagactttgcggtcgccttcgacggttttcaccaccagatcgttacgtccggacgcttcggcgctgacgccgagcgcgttcagcgcattgagcacaatcgacgtggagatagttttatcgtactccggcttgccagccataaaggtaaagcaggtattgccgagatcgtggaacaccgcgccgccaccgctactgcgccgcgccaggcggacgttatcttcttccatccgccgggtattacactctttccacgggttctgcgcgcgaccaattactaccgtgtcggcattgcgccagagaaacagaacgcgctgcgtggcgggcatttggcgaaaaatacactcttccaccgccaggttaaaccacgggtcgtaagagtcagagatgagcaggcgtaatgtggacataacgatttcctttcttgtagtaatgggtcactcttttttctcgctttcttcctcttccggcaccggtttgctggcggttaacaggaagggcgattgctgccagcgggtgcgtttaccctgtagcagcgtgcgggtcagcactacaccgattgccagtgagagcagcaacatcaggcgtaaaatgttagtggtgttatccacctgttgggcttcggtggcgagcgtatgggtgtcgagtgtcaggcgcagatagccgagcggtccgtttttacccgcaattggctcgacaatctgctggttaaaatagccgcctgcttttttaccgtcgagcgccagccggtcgcgcacttcgacgctttcgccagaacgtgcgataagatcgccttgttcgtcatacacacccgcgtcgaggatacggctttcatccgttaactgatcgaggatcgcctgaatgcgtttttcatccggtgagtcggtacgcatcagcggtgcaacgttcagcgtcacctgacgcgccagggtgcgggccagttcttccagctgtggattacgctgtcgctggtggttttgactaaaccatgacgctccctgcatcagcgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacaacgtctgacccaataccagagcaaactgggtgcggcgatggtgattgttgccgcctggtgcgtggaagattatcaggtgattcgtctggcaggttcactcaccgcacgggctacacgcctggcccacgaagcgcagctggatgtcgccccgctggggaaaatcccgcacctgcgcacgccgggtttgctggtgatggatatggactccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatacctgcgcgacaagctgcgcctgaccgccgtggtagccaatgaactggagatcatggacggtaaatttaccggcaatgtgatcggcgacatcgtagacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaggcggaagtcaccatccgtcacgctgacctgatgggggtattctgcatcctctcaggcagcctgaatcagaagtaattgctcgcccgccatcctgcgggcggcacagcattaacgaggtacaccgtggcaaaagctccaaaacgcgcctttgtttgtaatgaatgcggggccgattatccgcgctggcaggggcagtgcagtgcctgtcatgcctggaacaccatcaccgaggtgcgtcttgctgcgtcgccaatggtggcgcgtaacgagcgtctcagcggctatgccggtagcgccggggtggcaaaagtccagaaactctccgatatcagccttgaagagctgccgcgtttttccaccggatttaaagagttcgaccgcgtactaggcggcggcgtggtgccaggaagtgccattctgattggcggtaaccctggtgcggggaaatccacgctgctactgcaaacgctgtgcaaactggcccagcagatgaaaacgctgtatgtcaccggcgaagagtcgctgcaacaggtggcaatgcgcgctcatcgccttggcctgccgactgacaatctcaatatgttgtcggaaaccagcatcgaacagatctgcctgattgccgaagaagagcaaccgaagctgatggtaattgactcgatccaggtgatgcatatggcggatgtacagtcatcgcctggtagcgtggcgcaggtgcgtgaaacggcggcttatttgacacgcttcgccaaaacgcgcggtgtggcgattgtcatggtggggcacgtaaccaaagatggttcgctggctggcccgaaagtgctggaacactgtatcgactgttcggtgcttttggatggcgatgccgactcccgttttcgcaccttgcgcagccataaaaaccgcttcggcgcggtgaatgagctgggcgtcttcgcgatgaccgaacaggggctgcgtgaagtcagcaacccttcggcaattttcttaagtcgcggcgatgaagtgacctccggtagctcagtgatggtggtatgggaaggaacgcgtccactgctggtggagattcaggcgctggtcgatcactcgatgatggcgaacccacgccgcgtggcagtggggctggaacaaaaccgtctggcaatcctgctggctgtgttgcaccgtcacggtggtctgcaaatggccgatcaggatgtgtttgtgaacgtggtcggcggcgtgaaggtaaccgaaaccagtgccgacttagcgttactgctggcgatggtttccagcctgcgcgacagaccgctgccgcaggatctggtggtgtttggtgaagtcgggctggcaggggagatccgcccggtgcccagcggtcaggaacgaatctctgaagcggcgaaacacggttttcgccgggcgattgttccggcggctaacgtgccgaaaaaagcgccggaagggatgcagatttttggcgttaaaaaactctccgacgcgcttagcgtgttcgacgacttataatgagatatacggagggagatatgtcgtcatttgattacctgaaaactgccatcaagcaacagggctgcacgctacagcaggtagctgatgccagcggtatgaccaaagggtatttaagccagttactgaatgccaaaatcaaaagccccagcgcgcaaaagctggaggcgttgcaccgttttttggggcttgagtttccccggcagaagaaaacgatcggtgtcgtattcggtaagttctacccactgcataccggacatatctaccttatccagcgcgcctgtagccaggttgacgagctgcatatcattatgggttttgacgatacccgtgaccgcgcgttgttcgaagacagtgccatgtcgcagcagccgaccgtgccggatcgtctgcgttggttattgcaaacttttaaatatcagaaaaatattcgcattcatgctttcaacgaagagggcatggagccgtatccgcacggctgggatgtgtggagcaacggcatcaaaaagtttatggctgaaaaagggatccagccggatctgatctacacctcggaagaagccgatgcgccacagtatatggaacatctggggatcgagacggtgctggtcgatccgaaacgtacctttatgagtatcagcggtgcgcagatccgcgaaaacccgttccgctactgggaatatattcctaccgaagtgaagccgttttttgtgcgtaccgtggcgatccttggcggcgagtcgagcggtaaatccaccctggtaaacaaacttgccaatatcttcaacaccaccagtgcgtgggaatatggccgcgattatgtcttttcacacctcggcggtgatgagatcgcattgcagtattctgactacgataaaatcgcgctgggccacgctcaatacattgattttgcggtgaaatatgccaataaagtggcatttatcgataccgattttgtcaccactcaggcgttctgcaaaaagtacgaagggcgggaacatccgttcgtgcaggcgctgattgatgaataccgtttcgatctggtgatcctgctggagaacaacacgccgtgggtggcggatggtttacgcagcctcggcagttcggtggatcgcaaagagttccagaacttgctggtggagatgctcgaagagaacaatatcgaatttgtgcgggttgaagaggaagattacgacagtcgtttcctgcgctgcgtggaactggtgcgggagatgatgggggagcagagataaccgtgatgaaactgctcaaaggcgaggtataaaatgagtttttttgatgagttgaaaacctctctggaagaggctgtcgagattaaacaaggtttgaaaaaacctgcacgggtgacccgccacgaaattgaggatgctaaggctgttgtagaccggaaacggtgttcacgccgcatccggcattcggtgctcaatgcctgatgcgacgcttaccgcgtcttatcaggcctacagttttacaacgtattgaaattgctggttttgtaggccggataaggcgttcgcgccgcatccggcattttacgcattacttcgcaatacgcttgtacttgatacgcttcggctccagcgcgtctgcgcccagcgtgcgtttcttgtactcttcgtactcggtaaagttaccttcgaagaactcaactttaccttcatcctggtaatccagaatgtgcgtggcgatacggtcgaggaaccaacggtcgtgcgagataaccatcgcacagcccgggaactccagcagggcgttttccagcgcgcgcagggtttcgatatccaggtcgttggttggttcgtcgagcagcagcatgttgccgccaacctgcagcagcttcgccagatgcagacgaccgcgctcaccaccggagagttcaccaacgcgtttaccctgatcaacccctttaaagttaaagcggccaacgtaggcgcggcttggcatctcggtgttgccgatcttcatgatatccagcccgccggaaacttcttcccaaacggttttgctgttatccattgagtcacggaactgatcaaccgacgccagtttcaccgtttcacccaaagtgatggtgccgctgtccggctgttcctgaccagagatcatacggaacagggtcgatttacccgcaccgttcggaccgatgatcccgacgatcgctcctttcgggatcgagaagctcaggtcatcaatcagcagacgatcgccataggatttacgcaggttgctgacttccagcactttatcgcccagacgcggtccaggtggaataaacagttcgttggtttcgttacgtttctgatattcggtgctgttcagttcttcaaagcgcgccagacgtgctttacctttcgactgacggcctttagtaccttgacgtacccattccagctctttctcaatcgacttacgacgcgccgcttcttgtgaagcttcctgcgccaggcgctgatctttctgctccagccaggaggagtagttaccttcccacggaataccttcaccgcggtcaagttcgaggatccagcctgcaacgttatcgaggaagtaacggtcgtgggtaatcgccacaacggtgccttcgaagtcgtgcaggaagcgttccagccaggccacggattcggcatccaggtggttggtcggttcgtcgagcagcagcatgtctggtttttccagcagcaggcggcacaacgctacgcgacgacgttcaccaccggagaggttagcgattttcgcgtcccagtccggcagacgtagcgcatccgccgcacgctccagctgtacgttcagattatgaccgtcgtgagcctgaatgatctcttccagacggccttgttcagcggccagcttgtcaaaatcggcatccggatcggcgtacagcgcatacacttcatccaggcgtttcagggcgttaaccacttctgaaaccgcttcttcaatggactcacgcacggtgtgttccgggttcagctgcggttcctgcggcagataaccaatcttgatgtctggctgcggacgcgcttcaccttcgatgtctttatcaatgcccgccataatgcgcagcagggtggacttacccgcgccattcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgataatgagttttcaaaggcgaagtgtagcctttttccccgcctaatcccagccggtcgatcaccctcgcagtaaaagtaaaaaagtgtccgtaacgtggcgtaaacggcaatgactggttagcataaatctattacgcggcatgacgctgcattgatgtatttacacttagaggatgcgcttgtggaaaaagccaaacaagttacctggcggctgttggctgccggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaggattatccgctttatccctacctggaataccgccagatcaccgatgatctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacacaggcctggtaacagtgctggcagggcagatgcctgccgattaccagactatcgcctcggcaatcatttcactggcgaacaaccctaatacggtactgaccttcgcgcgtacaactggcgcgaccgattttacccgtcaaatggcggcggtggcgtttgccagtgtggcgcggcaggatgctgagaatgcacggctgatgatcccatcgcttgcccaggcgcagcagcttaatgaagatcagattcaggagctgcgcgatatcgtcgcctggcgtttgatgggcaacgatgtcaccgacgagcaggcgaaatggcgcgatgacgccattatgcgctcgcaatctacttcgcttattgaacgccgtgtacgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgcagcacaacgcatcggcgaagagtatgagctgaagattgataaagcgccgcagaatgttgacagcgccctgactcaggggccggagatggcgcgcgtgcgcgagttgatgtactggaatctcgataataccgcgcgtagcgagtgggccaatctggtgaagagcaagtcaaaaacagagcaggctcaactggcgcggtatgctttcaacaaccaatggtgggatcttagcgttcaggcaacgatcgccgggaagctgtgggatcatctggaagagcgattcccgctggcttacaacgatcttttcaaacgctacaccagcggtaaggagatcccgcaaagctatgcgatggcgattgctcgtcaggagagcgcctggaatccgaaagtgaaatcaccggtaggggccagcggcttgatgcagattatgcctggtacagcgacccatacggtgaagatgttctctattcccggttatagcagtcctgggcaattgctggatccggaaacgaatatcaacattggcaccagttacctgcaatatgtttatcagcagtttggcaataatcgtattttctcctcagcagcttataacgccggaccagggcgggtgcgaacctggcttggcaacagcgccgggcgtatcgacgcagtggcatttgtcgagagtattccattctccgagacgcgcggttatgtgaagaacgtgctggcttatgacgcttactaccgctatttcatgggggataaaccgacgttgatgagcgccacggaatggggacgtcgttactgatccgcacgtttatgatatgctatcgtactctttagcgagtacaaccgggggaggcattttgcttcccccgctaacaatggcgacatattatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaactcggcgcaggcatcgcgacgattacgcgtggatctaacagcctgaaagccgcgcccgtcgagctgcgccagtggctggaagaggtgttgctgaaaagcgattgattttgtaggcctgataagacgtggcgcatcaggcatcgtgcaccgaatgccggatgcggcgtgaacgccttatccgtcctacaaatacccgtaatttcaatatgtttggtaggcatgataagacgcggcagcgtcgcatcaggcgcttaatacacggcattatgaaacggactcagcgccaggatcaccgcctggtgatagacgctggcgcgagtgagtttcccggcggtaaacacgccgatcgccccttccttacgaccaatctcatcaataccggtataacgcgacatcacgggaccaagcgcctcaccttcacgcactttttccagaatcaccgcaggcaacggcaaagtagccgaacgcgcctcgccgcgctggctggcgttttcaatcaccacccaactgaaagtgctgtcaccatcgatgccagcttcaatcgccacccaaaaatcagcctctggaagtaaacggcgggcattggctacccgatttcgtgcgccagcgcgcgtttcctcactgccaaagggctgttccggtacaccgctctcgacggcaacggatgcaatatggcaggatccttcgccgaagatctcgtgaaatgcctgcagaatggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagtcatggtattgcactgggatgcctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaacgacggatcggaatcagcagttcacagcgtagattaattgggcgatctcccgctttggcatcttctgccgggtagtatcgctcaatatcctgacctttacggcgcgtcaggttgagcattggcatgcacgttccgtataccgtcaggataaactcctgcacgccggttcccagaccttcataggtaaacatcacatattcgccgccctgcagcatcaccggatgccccgtcagtacatagccatctgcctgatcctgggctaacgcggtggtatagaatacctcttgctcgtcgtctttatcctgactcggacgcgtttcattcaggccgtagagcaccggcggaatggtcggcgcgttgccgagaaaatcgtgccagaactgataacgcatttcatggcggaaatcagagatttgctccagcgaacaggagtagctctgggtaacaccaatcagcggcgtatcttccagggtgacaaatttgtgctctggcatagtgaattcacccaggcgtagcggcgggcgaataccaaaggcgctccattcaggagaacggcggtaaagtgcaggagtctgggcaaactgcttcttgaatgcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggctgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtagagtatgttttagggcttgacggaaataaaagtattgagattttgttcttaatcaatatgttatttaccgtgacgaactaattgctcgtgtaatagataaaaatggtaacaatatgaaatacaagcatttgatcctgtctttaagcctgataatgctggggccattggctcatgcagaagagattggttcggtcgacaccgtatttaaaatgatcggcccggatcacaaaattgttgtggaagcctttgatgatcccgatgtgaaaaatgtcacctgttatgtgagccgggcgaaaaccggtggtattaaagggggattgggtctggcggaagatacctccgatgcggccatttcttgtcagcaagtcgggccgattgaactgtcggatcgtattaaaaacggcaaagctcagggcgaggtagtattcaaaaaacgcacgtccctggtctttaagtcgttacaggtcgtgcgcttttatgatgccaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtggaagatgagcaagggatagccgacacgctggtctacatgttgcagcaggaaggttttgccgtcgaggtctttgagcgaggcttgccggtgctggataaagctcgcaagcaggtacccgacgtcatgattctcgatgttggtctgccggatattagcggctttgaattgtgccgccagttactggcgctccatccggcgttacctgtactgttcctgacggcccgaagtgaagaggtcgatcgcctgcttgggctggaaattggtgctgacgactacgtggctaaaccgttttcaccccgcgaagtgtgcgccagggtgcgcaccttactgcgtcgggtgaagaagttctcgacgccgtctcccgtcatccgtattggacattttgaattgaatgaacccgcggcgcagatcagctggtttgacacgccattagcgctgactcggtatgagtttttattgttgaagacgttactcaagtcaccgggccgcgtctggtcccgccagcaactgatggatagcgtatgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaatgcgtatcggcatgcggttgttgctgggctattttttactggtggcggtggcagcctggttcgtactggccatttttgtcaaagaagttaaaccgggcgtgcgaagagcaacggaggggacgttgatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaatgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcaccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgcccggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttacgcattaactcatgagctaaaaagcccactggcggcgattcgtggagcggcggaaattttacgcgaaggtccgccgccggaagtggtggctcgttttactgacaacattctgacgcaaaatgcgcgtatgcaggcattggtagaaacgttactacgccaggcaagactggagaatcgtcaggaagtcgttctgactgctgttgatgtggcggcattattccgccgcgtcagcgaagcgcgcaccgtgcagttggcagaaaaaaaaatcactctgcatgttacgcccaccgaggttaacgttgctgctgaaccggcgttactggagcaggcgctgggaaatttactggataacgccatcgattttacccccgagagcggttgcatcacgctaagcgccgaagtggatcaggaacacgtcacgcttaaggtgctggataccggtagtggtattcctgactacgcgctttcacgtatttttgaacgcttttactctttgcctcgtgcaaatgggcaaaaaagcagcggtctggggttggcgttcgtcagtgaggtcgcccgtttgtttaacggcgaagtcacgctgcgcaacgtgcaggaaggtggcgtgctggcctcgcttcgacttcaccgtcacttcacatagcttcaaattcttcccacatagtcttcgtatcctgctgccattgcaaaggagaagactatgttgaaatcccccctgttctggaaaatgactagcctgtttggtgcagtattgctgttgttgattccgataatgctgattcggcaggtgattgtcgaacgtgctgattaccgtagcgatgtggaagatgcgattcgccaaagtaccagcgggccgcaaaaactcgttgggccgctcatcgctattcctgtgaccgagctttatacggtgcaggaagaggataaaaccgtggagcggaaacgaagttttatccatttttggttacctgagtcattgatggttgatggcaatcagaacgtggaagaacgcaagatagggatttataccggtcaggtctggcacagtgatttaacgttaaaagccgatttcgatgtttcgcgtcttagcgaactcaacgcgccaaatatcaccttaggcaagccatttattgtgattagcgtcggggatgcgcgtggtattggtgtggtgaaagcgcctgaagttaacggaacggcgctgaccattgaacccggcaccgggttagagcaaggcgggcagggcgtgcatatccctttacctgaaggggactggcggaagcagaacctgaagctgaatatggccctgaatttaagcggtaccggcgatctttctgtggtgcctggcgggcgtaatagcgaaatgaccttaaccagcaactggccgcatcccagttttttaggtgattttctaccagccaaacgggaagttagcgagtcaggttttcaggcgcactggcaaagcagctggtttgctaataatctcggtgagcgttttgcttcaggcaatgataccggctgggaaaacttcccggcgtttagcgtcgcagtaacgacgccagccgatcaataccaattaactgaccgggcgactaagtacgccattctgctgattgcactgacttttatggcgttctttgtttttgaaacgctcaccgcgcaacgtttacacccaatgcaatatttgctggtggggctttcattggtgatgttttatttgctcttgctggcgctttctgaacataccggttttaccgtggcatggataatcgccagtctgattggggcgataatgaacggtatttatttgcaagcggtattgaaaggttggtgcaacagcatgttgtttaccctcgcgctgttgttgctggatggtgtgatgtggggactgctcaactctgccgatagcgcgctgttgttgggaaccagtgtgctggtggtggcgctggccggcatgatgtttgtgacccgtaatatcgactggtatgcgttttcactgccgaaaatgaaagccagtaaagaagttacaacggacgatgagttacgtatctggaaataaggttgaaaaataaaaacggcgctaaaaagcgccgttttttttgacggtggtaaagccgattaatcttccagatcaccgcagaagcgataaccttcaccgtgaatggtggcgatgatttccggcgtatccggcgtagattcgaaatgtttacgaatacggcggatcgtcacgtctacagtacggtcgtgcggtttcagctcacggccggtcattttcttcagcagttcagcacgggactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagtaggttgcgtgcacgaatcgtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgttcttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaacataacaggctaagaggggccggacacccaataaaactacgcttcgttgacatatatcaagttcaattgtagcacgttaacagtttgatgaaatcatcgtatctaaatgctagctttcgtcacattattttaataatccaactagttgcatcatacaactaataaacgtggtgaatccaattgtcgagatttattttttataaaattatcctaagtaaacagaaggatatgtagcattttttaacaactcaaccgttagtacagtcaggaaatagtttagccttttttaagctaagtaaagggctttttctgcgacttacgttaagaatttgtaaattcgcaccgcgtaataagttgacagtgatcacccggttcgcggttatttgatcaagaagagtggcaatatgcgtataacgattattctggtcgcacccgccagagcagaaaatattggggcagcggcgcgggcaatgaaaacgatggggtttagcgatctgcggattgtcgatagtcaggcacacctggagccagccacccgctgggtcgcacatggatctggtgatattattgataatattaaagttttcccgacattggctgaatcgttacacgatgtcgatttcactgtcgccaccactgcgcgcagtcgggcgaaatatcattactacgccacgccagttgaactggtgccgctgttagaggaaaaatcttcatggatgagccatgccgcgctggtgtttggtcgcgaagattccgggttgactaacgaagagttagcgttggctgacgttcttactggtgtgccgatggtggcggattatccttcgctcaatctggggcaggcggtgatggtctattgctatcaattagcaacattaatacaacaaccggcgaaaagtgatgcaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataaaaaacgccttagtaagtatttttc

SEQ ID NO: 2 - DNA, 4639675 bp, E. coli; identical to SEQ ID NO: 1
  mutation (1679479)...(1679479): T to C
  mutation (1976527)...(1977302): Deletion of 776bp
  mutation (2405257)...(2405257): G to C
  mutation (2534334)...(2534334): Insertion deletion IS186 (-) +6 bp :: delta.1 at nucleotides 479-484 of crr CDS
  mutation (2740321)...(2740321): T to C
  mutation (2932138)...(2932138): T to A
  mutation (3279141)...(3279141): C to T
  mutation (3315496)...(3315496): A to G
  mutation (3955730)...(3955730): G to A
  mutation (3957957)...(3957957): C to T
  mutation (3990407)...(3990414): Deletion of 8 bp
  mutation (4153541)...(4153541): A to G
  mutation (4294403)...(4294403): Insertion of CG
  mutation (4306572)...(4306572): 3434bp to 82bp
  mutation (507894)...(507894): T to C
  mutation (547694)...(547694): A to G
  mutation (547831)...(547831): Insertion of G
  mutation (751964)...(751964): C to T

SEQ ID NO: 3 - DNA, 4639675 bp, E. coli; identical to SEQ ID NO: 1
  mutation (1022011)...(1022011): C to T
  mutation (1760136)...(1760136): G to A
  mutation (1929016)...(1929016): G to A
  mutation (1976527)...(1977302): Deletion of 776bp
  mutation (2405257)...(2405257): G to C
  mutation (2534334)...(2534334): Insertion deletion IS186 (-) +6 bp :: delta.1 at nucleotides 479-484 of crr CDS
  mutation (2740321)...(2740321): T to C
  mutation (2932138)...(2932138): T to A
  mutation (3279141)...(3279141): C to T
  mutation (3429378)...(3429378): T to C
  mutation (345189)...(345189): A to G
  mutation (3957957)...(3957957): C to T
  mutation (3990407)...(3990414): Deletion of 8 bp
  mutation (4153541)...(4153541): A to G
  mutation (4294403)...(4294403): Insertion of CG
  mutation (4306572)...(4306572): 3434bp to 82bp
  mutation (454725)...(454725): C to T
  mutation (507894)...(507894): T to C
  mutation (547694)...(547694): A to G
  mutation (547831)...(547831): Insertion of G
  mutation (700679)...(700679): Insertion of G
  mutation (961467)...(961467): C to T

SEQ ID NO: 4 - DNA, 4639675 bp, E. coli; identical to SEQ ID NO: 1
  mutation (1247873)...(1247873): G to A
  mutation (1580390)...(1580390): A to G
  mutation (1976527)...(1977302): Deletion of 776bp
  mutation (2358479)...(2358479): Insertion of C
  mutation (2405257)...(2405257): G to C
  mutation (2534334)...(2534334): Insertion deletion IS186 (-) +6 bp :: delta.1 at nucleotides 479-484 of crr CDS
  mutation (2740321)...(2740321): T to C
  mutation (2926442)...(2926442): Insertion of T
  mutation (2932138)...(2932138): T to A
  mutation (3246033)...(3246033): G to A
  mutation (3279141)...(3279141): C to T
  mutation (3335733)...(3335733): C to T
  mutation (3548297)...(3548297): T to C
  mutation (3957957)...(3957957): C to T
  mutation (3990407)...(3990414): Deletion of 8 bp
  mutation (4294403)...(4294403): Insertion of CG
  mutation (4306572)...(4306572): 3434bp to 82bp
  mutation (454725)...(454725): C to T
  mutation (4604230)...(4604230): Insertion of G
  mutation (507894)...(507894): T to C
  mutation (533362)...(533362): A to G
  mutation (547694)...(547694): A to G
  mutation (547831)...(547831): Insertion of G
  mutation (700599)...(700599): Insertion of C
  mutation (922473)...(922473): Insertion of G

SEQ ID NO: 5 - DNA, 4639675 bp, E. coli; identical to SEQ ID NO: 1
  mutation (1135244)...(1135244): A to G
  mutation (1163111)...(1163111): A to G
  mutation (1610530)...(1610530): Insertion of C
  mutation (1950262)...(1950262): G to A
  mutation (1976527)...(1977302): Deletion of 776bp
  mutation (2405257)...(2405257): G to C
  mutation (2534334)...(2534334): Insertion deletion IS186 (-) +6 bp :: delta.1 at nucleotides 479-484 of crr CDS
  mutation (2662540)...(2662540): T to C
  mutation (2740321)...(2740321): T to C
  mutation (2826646)...(2826646): G to A
  mutation (2927497)...(2927497): G to A
  mutation (2932138)...(2932138): T to A
  mutation (3279141)...(3279141): C to T
  mutation (34111)...(34111): Insertion of T
  mutation (379237)...(379237): Deletion of 1 bp
  mutation (3957957)...(3957957): C to T
  mutation (3990407)...(3990414): Deletion of 8 bp
  mutation (4294403)...(4294403): Insertion of CG
  mutation (4306572)...(4306572): 3434bp to 82bp
  mutation (507894)...(507894): T to C
  mutation (547694)...(547694): A to G
  mutation (547831)...(547831): Insertion of G
  mutation (700286)...(700286): Insertion of C
  mutation (844446)...(844446): C to T

SEQ ID NO: 6 - DNA, 4639675 bp, E. coli; identical to SEQ ID NO: 1
  mutation (1260197)...(1260197): C to T
  mutation (1950262)...(1950262): G to A
  mutation (1976527)...(1977302): Deletion of 776bp
  mutation (2405257)...(2405257): G to C
  mutation (2534334)...(2534334): Insertion deletion IS186 (-) +6 bp :: delta.1 at nucleotides 479-484 of crr CDS
  mutation (2620968)...(2620968): Deletion of 1bp
  mutation (2662540)...(2662540): T to C
  mutation (2740321)...(2740321): T to C
  mutation (2763809)...(2763809): Insertion of C
  mutation (2767188)...(2767188): G to A
  mutation (2826646)...(2826646): G to A
  mutation (2927497)...(2927497): G to A
  mutation (2932138)...(2932138): T to A
  mutation (3114125)...(3114125): C to T
  mutation (3218853)...(3218853): T to C
  mutation (3268091)...(3268091): C to T
  mutation (3268123)...(3268123): C to A
  mutation (3268165)...(3268165): C to T
  mutation (3279141)...(3279141): C to T
  mutation (3302829)...(3302829): Deletion of 1 bp
  mutation (34111)...(34111): Insertion of T
  mutation (379237)...(379238): Deletion of 2 bp
  mutation (3957957)...(3957957): C to T
  mutation (3983344)...(3983344): C to T
  mutation (3990407)...(3990414): Deletion of 8 bp
  mutation (4234068)...(4234068): T to G
  mutation (4294403)...(4294403): Insertion of CG
  mutation (4306572)...(4306572): 3434bp to 82bp
  mutation (4503718)...(4503718): G to A
  mutation (507894)...(507894): T to C
  mutation (547694)...(547694): A to G
  mutation (547831)...(547831): Insertion of G
  mutation (700286)...(700286): Insertion of C
  mutation (844446)...(844446): C to T

SEQ ID NO: 7 - DNA, 4639675 bp, E. coli; identical to SEQ ID NO: 1
  mutation (1137595)...(1137595): A to G
  mutation (1274794)...(1274794): T to C
  mutation (1435247)...(1435247): Deletion of 1bp
  mutation (1440978)...(1440978): G to A
  mutation (1604028)...(1604028): T to C
  mutation (1682336)...(1682336): A to G
  mutation (1729483)...(1729483): G to A
  mutation (1976527)...(1977302): Deletion of 776bp
  mutation (2071288)...(2071288): G to A
  mutation (2085304)...(2085304): Insertion of G
  mutation (2098010)...(2098010): T to C
  mutation (2405257)...(2405257): G to C
  mutation (2534334)...(2534334): Insertion deletion IS186 (-) +6 bp :: delta.1 at nucleotides 479-484 of crr CDS
  mutation (2732557)...(2732557): Insertion of C
  mutation (2740321)...(2740321): T to C
  mutation (2809146)...(2809146): Insertion of A
  mutation (2844070)...(2844070): G to A
  mutation (2927497)...(2927497): G to A
  mutation (2932138)...(2932138): T to A
  mutation (2965591)...(2965591): T to C
  mutation (2975919)...(2975919): T to C
  mutation (3279141)...(3279141): C to T
  mutation (34111)...(34111): Insertion of T
  mutation (3526004)...(3526004): T to C
  mutation (379237)...(379237): Deletion of 1 bp
  mutation (386281)...(386281): C to T
  mutation (3957957)...(3957957): C to T
  mutation (3982057)...(3982057): C to T
  mutation (3990407)...(3990414): Deletion of 8 bp
  mutation (407943)...(407943): A to G
  mutation (4294403)...(4294403): Insertion of CG
  mutation (4306572)...(4306572): 3434bp to 82bp
  mutation (4444833)...(4444833): A to G
  mutation (4604346)...(4604346): Deletion of 1 bp
  mutation (507894)...(507894): T to C
  mutation (547694)...(547694): A to G
  mutation (547831)...(547831): Insertion of G
  mutation (560913)...(560913): Insertion of G
  mutation (653396)...(653396): T to C
  mutation (696062)...(696062): G to A
  mutation (700027)...(700027): C to T
  mutation (760544)...(760544): C to T

SEQ ID NO: 8 - DNA, 4639675 bp, E. coli; identical to SEQ ID NO: 1
  mutation (111897)...(111897): G to A
  mutation (1137595)...(1137595): A to G
  mutation (1274794)...(1274794): T to C
  mutation (1386732)...(1386732): A to G
  mutation (1440978)...(1440978): G to A
  mutation (1682336)...(1682336): A to G
  mutation (1729483)...(1729483): G to A
  mutation (1866695)...(1866695): G to A
  mutation (1976527)...(1977302): Deletion of 776bp
  mutation (2071288)...(2071288): G to A
  mutation (2085304)...(2085304): Insertion of G
  mutation (2098010)...(2098010): T to C
  mutation (2257220)...(2257220): A to G
  mutation (2405257)...(2405257): G to C
  mutation (2534334)...(2534334): Insertion deletion IS186 (-) +6 bp :: delta.1 at nucleotides 479-484 of crr CDS
  mutation (2732557)...(2732557): Insertion of C
  mutation (2740321)...(2740321): T to C
  mutation (2782127)...(2782127): A to G
  mutation (2809146)...(2809146): Insertion of A
  mutation (2824039)...(2824039): T to C
  mutation (2844070)...(2844070): G to A
  mutation (2927497)...(2927497): G to A
  mutation (2932138)...(2932138): T to A
  mutation (2975919)...(2975919): T to C
  mutation (3176882)...(3176882): G to A
  mutation (3279141)...(3279141): C to T
  mutation (34111)...(34111): Insertion of T
  mutation (3506796)...(3506796): T to C
  mutation (3526004)...(3526004): T to C
  mutation (379237)...(379237): Deletion of 1 bp
  mutation (3957957)...(3957957): C to T
  mutation (3978813)...(3978813): C to A
  mutation (3990407)...(3990414): Deletion of 8 bp
  mutation (4105271)...(4105271): A to G
  mutation (42111)...(42111): C to A
  mutation (4294403)...(4294403): Insertion of CG
  mutation (4306572)...(4306572): 3434bp to 82bp
  mutation (4444833)...(4444833): A to G
  mutation (507894)...(507894): T to C
  mutation (547694)...(547694): A to G
  mutation (547831)...(547831): Insertion of G
  mutation (558493)...(558493): G to T
  mutation (560913)...(560913): Insertion of G
  mutation (619171)...(619171): A to G
  mutation (653396)...(653396): T to C
  mutation (700027)...(700027): C to T
  mutation (760544)...(760544): C to T
  mutation (852434)...(852434): Insertion of A
  mutation (963462)...(963462): A to G

SEQ ID NO: 9 - DNA, 4639675 bp, E. coli; identical to SEQ ID NO: 1
  mutation (1137595)...(1137595): A to G
  mutation (1274794)...(1274794): T to C
  mutation (1440978)...(1440978): G to A
  mutation (1682336)...(1682336): A to G
  mutation (1729483)...(1729483): G to A
  mutation (1976527)...(1977302): Deletion of 776bp
  mutation (2071288)...(2071288): G to A
  mutation (2098010)...(2098010): T to C
  mutation (2405257)...(2405257): G to C
  mutation (2534334)...(2534334): Insertion deletion IS186 (-) +6 bp :: delta.1 at nucleotides 479-484 of crr CDS
  mutation (2740321)...(2740321): T to C
  mutation (2844070)...(2844070): G to A
  mutation (2927497)...(2927497): G to A
  mutation (2932138)...(2932138): T to A
  mutation (2975919)...(2975919): T to C
  mutation (3279141)...(3279141): C to T
  mutation (3526004)...(3526004): T to C
  mutation (386281)...(386281): C to T
  mutation (3957957)...(3957957): C to T
  mutation (3990407)...(3990414): Deletion of 8 bp
  mutation (4294403)...(4294403): Insertion of CG
  mutation (4306572)...(4306572): 3434bp to 82bp
  mutation (4444833)...(4444833): A to G
  mutation (507894)...(507894): T to C
  mutation (547694)...(547694): A to G
  mutation (547831)...(547831): Insertion of G
  mutation (560913)...(560913): Insertion of G
  mutation (653396)...(653396): T to C
  mutation (700027)...(700027): C to T
  mutation (760544)...(760544): C to T
